United States Patent
Muramatsu et al.

(10) Patent No.: US 9,663,799 B2
(45) Date of Patent: May 30, 2017

(54) HYDROCARBON SYNTHASE GENE AND USE THEREOF

(71) Applicants: Masayoshi Muramatsu, Miyoshi (JP); Masakazu Ito, Toyota (JP)

(72) Inventors: Masayoshi Muramatsu, Miyoshi (JP); Masakazu Ito, Toyota (JP)

(73) Assignee: TOYOTA JIDOSHA KABUSHIKI KAISHA, Toyota-shi, Aichi-ken (JP)

( * ) Notice: Subject to any disclaimer, the term of this patent is extended or adjusted under 35 U.S.C. 154(b) by 121 days.

(21) Appl. No.: 14/378,904

(22) PCT Filed: Feb. 26, 2013

(86) PCT No.: PCT/JP2013/054956
§ 371 (c)(1),
(2) Date: Aug. 14, 2014

(87) PCT Pub. No.: WO2013/129393
PCT Pub. Date: Sep. 6, 2013

(65) Prior Publication Data
US 2015/0056675 A1 Feb. 26, 2015

(30) Foreign Application Priority Data
Feb. 27, 2012 (JP) .................. 2012-040141

(51) Int. Cl.
*C12P 5/02* (2006.01)
*C12N 9/02* (2006.01)

(52) U.S. Cl.
CPC .............. *C12P 5/02* (2013.01); *C12N 9/0008* (2013.01); *C12Y 102/01048* (2013.01)

(58) Field of Classification Search
None
See application file for complete search history.

(56) References Cited

U.S. PATENT DOCUMENTS 6,437,218 B1 8/2002 Aarts et al.
2009/0217094 A1 8/2009 Matsumoto et al.

FOREIGN PATENT DOCUMENTS

| JP | 09-322780 A | 12/1997 |
|---|---|---|
| JP | 2010-528627 A | 8/2010 |
| JP | 2011-520455 A | 7/2011 |
| WO | 2006/109558 A1 | 10/2006 |
| WO | 2008/151149 A2 | 12/2008 |
| WO | 2009/140695 A1 | 11/2009 |

OTHER PUBLICATIONS

Accession C8T634. Nov. 3, 2009.*
Sen et al. Appl Biochem Biotechnol. Dec. 2007;143(3):212-23.*
Chica et al. Curr Opin Biotechnol. Aug. 2005;16(4):378-84.*
Kurita et al.,"Involvement of mitochondrial aldehyde dehydrogenase ALD5 in maintenance of the mitochondrial electron transport chain in *Saccharomyces cerevisiae*" FEMS Microbiology Letters, 181, (1999), pp. 281-287.
Zhang et al., A novel betaine aldehyde dehydrogenase gene from *Japtropha curcas*, encoding an enzyme implicated in adaption to environmental stress, Plant Science, vol. 174, 2008, pp. 510-518.
Molecular Cloning, A Laboratory Manual, Third Edition, 2001, vol. 2, Information Panels 10.47, 3 pages total.
"*Klebsiella pneumoniae* subsp. Rhinoscleromatis ATCC 13884 contig00142, whole genome shotgun sequence", Genbank, online NCBI, Sep. 22, 2009, <URL:http://www.ncbi.nlm.nih.gov/nuccore/259039720, Apr. 24, 2013, 2 pages.
"*Klebsiella pneumoniae* subsp. Pneumoniae NTUH-K2044 DNA, complete genome", Genbank, online NCBI, Mar. 1, 2013, <URL:http://www.ncbi.nlm.nih.gov/nuccore/AP006725.1, Apr. 24, 2013, 2 pages.
Fu-Li Zhang, et al., "A novel betaine aldehyde dehydrogenase gene from *Jatropha curcas*, encoding an enzyme implicated in adaptation to environmental stress", Plant Science, 2008, pp. 510-518, vol. 174.
N. Ladygina, et al., "A review on microbial synthesis of hydrocarbons", Process Biochemistry, 2006, pp. 1001-1014, vol. 41.
P. Metzger, et al., "*Botryococcus braunii*: a rich source for hydrocarbons and related ether lipids", Appl. Microbiol Biotechnol, 2005, pp. 486-496, vol. 66.
James R. Reed, et al., "Unusual mechanism of hydrocarbon formation in the housefly: Cytochrome P450 converts aldehyde to the sex pheromone component (Z)-9-tricosene and $CO_2$", Proc. Natl. Acad. Sci.USA, Oct. 1994, pp. 10000-10004, vol. 91.
International Search Report for PCT/JP2013/054956 dated May 14, 2013 [PCT/ISA/210].
Written Opinion for PCT/JP2013/054956 dated May 14, 2013 [PCT/ISA/237].
Coleman et al, Expression of a Glutamate Decarboxylase Homologue Is Required for Normal Oxidative Stress Tolerance in *Saccharomyces cerevisiae*, The Journal of Biological Chemistry; Aug. 6, 2000, pp. 244-250, vol. 276, No. 1, JBC Papers in Press, United States.
Blasi et al, Structure of human succinic semialdehyde dehydrogenase gene: identification of promoter region and alternatively processed isoforms, Molecular Genetics and Metabolism, May 16, 2002, pp. 348-362, Academic Press, United States.
XP-002735642 ( Retrieved from online Feb. 5, 2015) http://www.uniprot.org/uniprot/C4X2S5.txt?version=20.
XP-002735638 ( Retrieved from online Feb. 5, 2015) http:/www.uniprot.org/uniprot/Q9H2A2.txt?version=85.
XP-002735639 (Retrieved from online Feb. 5, 2015) http://ibis.internal.epo.org/exam/dbfetch.jsp?id=UNIPROT:F3Q423.

(Continued)

*Primary Examiner* — Christian Fronda
(74) *Attorney, Agent, or Firm* — Sughrue Mion, PLLC

(57) ABSTRACT

A hydrocarbon synthase gene encoding protein having excellent capacity to synthesize a hydrocarbon such as alkane and novel functions is provided. The gene encodes a protein comprising an amino acid sequence comprising a motif sequence shown in SEQ ID NO: 1 and having activity of synthesizing a hydrocarbon with a carbon number one less than that of an aldehyde compound from the aldehyde compound.

6 Claims, 11 Drawing Sheets

(56) References Cited

OTHER PUBLICATIONS

Chambliss et al, Molecular Cloning of the Mature NAD+—dependent Succinic Semialdehyde Dehydrogenase from Rat and Human, The Journal of Biological Chemistry, Jul. 11, 1994, pp. 461-467, The American Society of Biochemistry and Molecular Biology, Inc., United States.

XP-002735640 ( Retrieved from online Feb. 5, 2015) http://ibis.internal.epo.org/exam/dbfetch.jsp?id=UNIPROT:C8T1X9.

XP-002735641 ( Retrieved from online Feb. 5, 2015) http://www.uniprot.org/uniprot/C8T634.txt?version=14.

Zhang et al, A novel betaine aldehyde dehydrogenase gene from Jatropha curcas, encoding an enzyme implicated in adaptation to environmental stress, Planet Science, Feb. 17, 2008, pp. 510-518, Elsevier Ireland Ltd, China.

Ishige et al, Long-Chain Aldehyde Dehydrogenase That Participates in n—Alkane Utilization and Wax Ester Synthesis in *Acinetobacter* sp. Strain M-I, Applied and Environmental Microbiology, Aug. 2000, pp. 3481-3486, United States.

\* cited by examiner

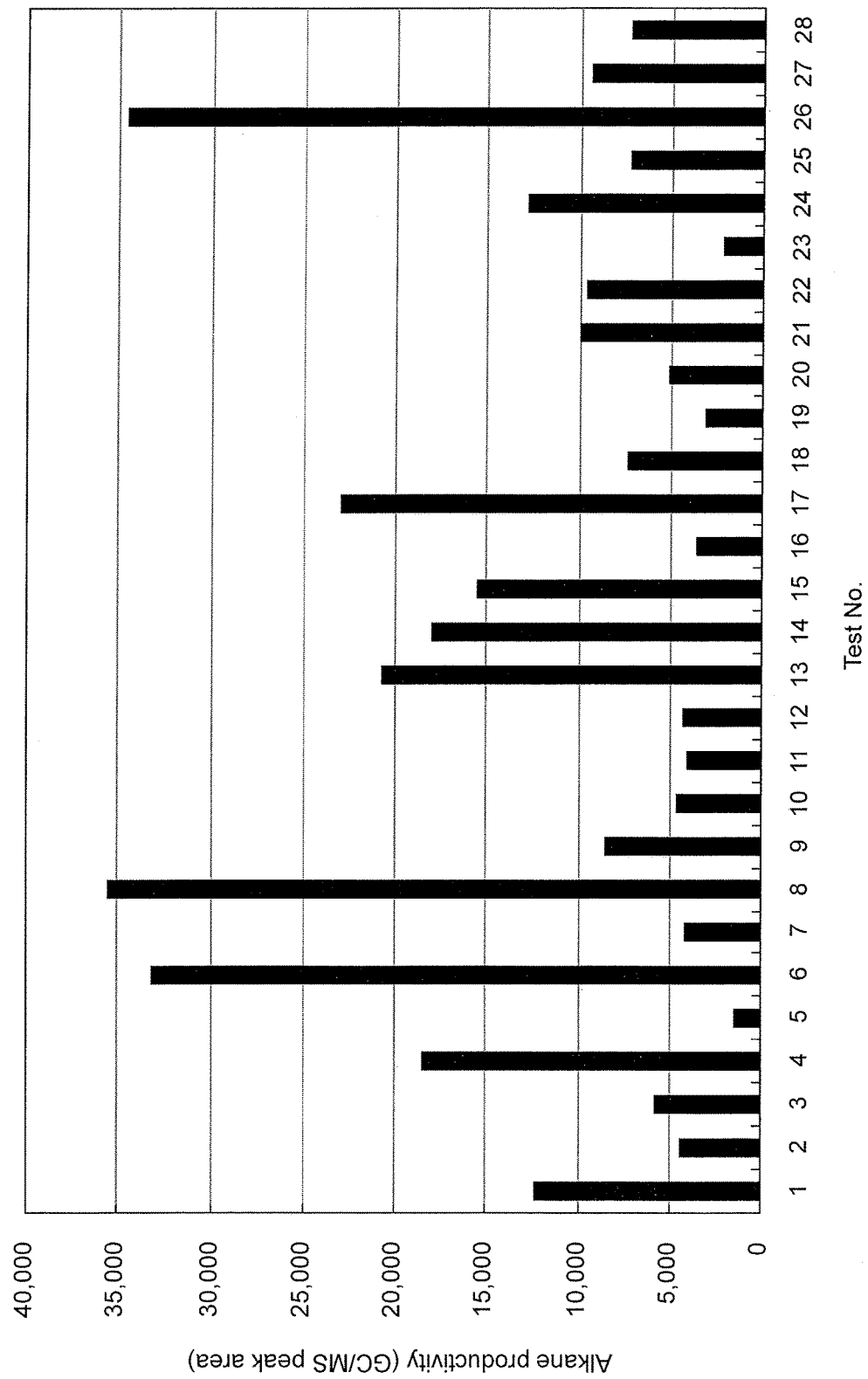

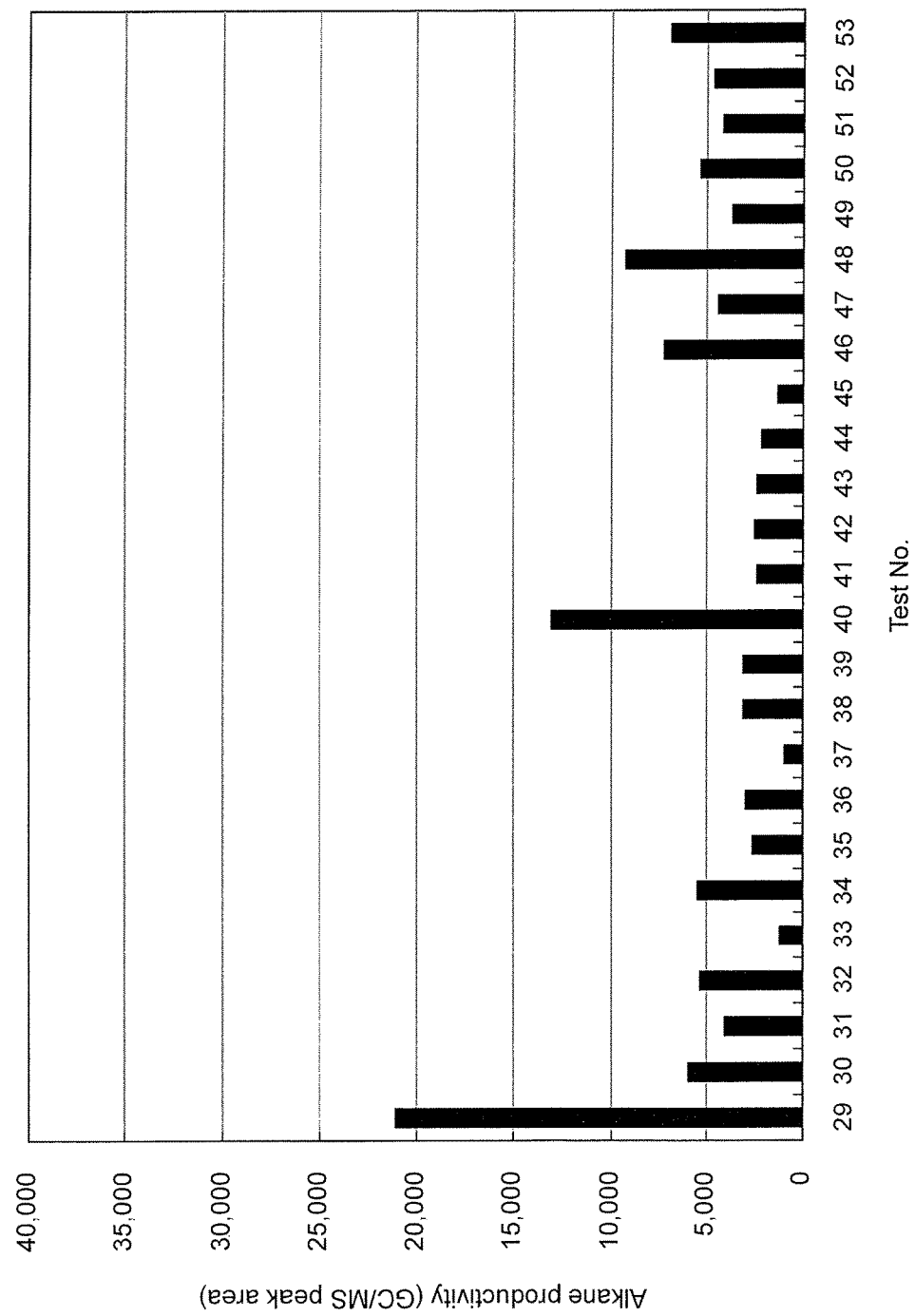

ial Stage of International
HYDROCARBON SYNTHASE GENE AND USE THEREOF

CROSS REFERENCE TO RELATED APPLICATIONS

This application is a National Stage of International Application No. PCT/JP2013/054956 filed Feb. 26, 2013, claiming priority based on Japanese Patent Application No. 2012-040141 filed Feb. 27, 2012, the contents of all of which are incorporated herein by reference in their entirety.

TECHNICAL FIELD

The present invention relates to a hydrocarbon synthase gene having novel features and the use thereof.

BACKGROUND ART

There are known microorganisms capable of synthesizing hydrocarbons such as alkane. It is expected that the development of recombinant microorganisms having excellent hydrocarbon synthesis capacity, hydrocarbon synthesis systems using the recombinant microorganisms, and the like would be possible through the isolation/separation of genes involved in hydrocarbon synthesis from such microorganisms having hydrocarbon production capacity. For example, Patent Literature 1 (WO2006/109558) discloses a method for obtaining a hydrocarbon from a culture product, which comprises culturing novel microalgae having hydrocarbon synthesis capacity, such as *Pseudochoricystis ellipsoidea*, or microalgae belonging to the genus *Pseudochoricystis* or *Choricystis* which have hydrocarbon production capacity.

In addition, Patent Literature 2 (JP Patent Publication (Kokai) No. 2010-528627 A) discloses a recombinant yeast obtained by incorporating a gene capable of converting aldehyde into alkane into yeast or the like and a method for producing alkane using the recombinant yeast. Patent Literature 3 (JP Patent Publication (Kohyo) No. 2011-520455 A) discloses an alkane synthase gene and an aldehyde synthase gene from *Synechococcus elongatus* and a method for producing alkane and aldehyde using such genes. Patent Literature 4 (JP Patent Publication (Kokai) No. 9-322780 (1997) A) discloses a gene encoding a protein involved in the activity of *Arabidopsis thaliana*-derived fatty aldehyde decarbonylase and a transformed plant showing an altered epicuticular wax composition obtained using the gene.

Further, Non-Patent Literature 1 (Process Biochemistry, 41, (2006), pp. 1001-1014) discloses the hydrocarbon synthesis pathway in a microorganism. Non-Patent Literature 2 (Appl. Microbiol. Biotechnol., (2005), 66: pp. 486-496) discloses biosynthesis of hydrocarbons in *Botryococcus braunii*, which is an alga, as in the case of Patent Literature 1. Patent Literature 3 (Proc. Natl. Acad. Sci., (1994), Vol. 91, pp. 10000-10004) discloses a fly-derived cytochrome P450 gene capable of converting aldehyde into a hydrocarbon ((Z)-9-tricosene).

However, applied use of the microorganism disclosed in Non-Patent Literature 1 and the fly-derived gene disclosed in Non-Patent Literature 3 at practical level cannot be expected because of low alkane production. In addition, in the cases of the algae disclosed in Non-Patent Literature 2 and Patent Literature 1, the alkane production reaction rate is low, resulting in intracellular accumulation of alkane. For such reasons, low-cost synthesis of alkane cannot be achieved even with the use of the algae disclosed in Non-Patent Literature 2 and Patent Literature 1 because alkane production is time-consuming and a step of purifying alkane from cells must be added. This is problematic. Further, there are no practical examples of successful alkane synthesis even by producing a recombinant with the gene disclosed in Patent Literature 4; such synthesis is not practical because an additional factor (i.e., an unknown gene) is necessary. Furthermore, even if a plant-derived gene is used for a microorganism, the gene might not sufficiently function therein. This is also problematic. In addition, the use of the cyanobacteria-derived alkane synthase gene disclosed in Patent Literature 3 would result in low productivity of alkane synthesis. The use of such gene is almost impractical.

CITATION LIST

Patent Literature

Patent Literature 1: WO2006/109558
Patent Literature 2: JP Patent Publication (Kokai) No. 2010-528627 A
Patent Literature 3: JP Patent Publication (Kohyo) No. 2011-520455 A
Patent Literature 4: JP Patent Publication (Kokai) No. 9-322780 (1997) A

Non Patent Literature

Non Patent Literature 1: Process Biochemistry, 41, (2006), pp. 1001-1014
Non Patent Literature 2: Appl. Microbiol. Biotechnol., (2005), 66: pp. 486-496
Non Patent Literature 3: Proc. Natl. Acad. Sci., (1994), Vol. 91, pp. 10000-10004

SUMMARY OF INVENTION

Technical Problem

In view of the above circumstances, an object of the present invention is to provide a hydrocarbon synthase gene having excellent capacity to synthesize a hydrocarbon such as alkane and novel functions and the use thereof.

Solution to Problem

As a result of intensive studies in order to achieve the above object, the present inventors have found that a group of proteins comprising a certain motif sequence have excellent activity of synthesizing a hydrocarbon with a carbon number one less than that of an aldehyde compound from the aldehyde compound, and that genes encoding the proteins can be used for hydrocarbon synthesis. This has led to the completion of the present invention.

(1) A gene encoding a protein comprising an amino acid sequence comprising a motif sequence shown in SEQ ID NO: 1 and having activity of synthesizing a hydrocarbon with a carbon number one less than that of an aldehyde compound from the aldehyde compound.
(2) The gene according to (1), wherein the protein further comprises a motif sequence shown in SEQ ID NO: 2 on the C-terminal side of the motif sequence shown in SEQ ID NO: 1.
(3) The gene according to (1), wherein the protein is any of the following (a) to (d):
(a) a protein comprising an amino acid sequence shown in any even-numbered sequence ID number of SEQ ID NOS: 3 to 32 and 65 to 170;

(b) a protein comprising an amino acid sequence derived from the amino acid sequence shown in any even-numbered sequence ID number of SEQ ID NOS: 3 to 32 and 65 to 170 by substitution, deletion, insertion, or addition of one or a plurality of amino acids and having activity of synthesizing a hydrocarbon with a carbon number one less than that of an aldehyde compound from the aldehyde compound;
(c) a protein comprising an amino acid sequence having 70% or more identity to an amino acid sequence shown in any even-numbered sequence ID number of SEQ ID NOS: 3 to 32 and 65 to 170 and having activity of synthesizing a hydrocarbon with a carbon number one less than that of an aldehyde compound from the aldehyde compound; and
(d) a protein encoded by a polynucleotide that hybridizes under stringent conditions to at least a portion of a polynucleotide comprising a sequence complementary to a nucleotide sequence shown in any odd-numbered sequence ID number of SEQ ID NOS: 3 to 32 and 65 to 170 and having activity of synthesizing a hydrocarbon with a carbon number one less than that of an aldehyde compound from the aldehyde compound.
(4) The gene according to (3), wherein the even-numbered sequence ID number of SEQ ID NOS: 3 to 32 is SEQ ID NO: 6 or 12 and the odd-numbered sequence ID number of SEQ ID NOS: 3 to 32 is SEQ ID NO: 5 or 11.
(5) The gene according to (1), which is derived from a microorganism belonging to the genus *Klebsiella* or from *Escherichia coli*.
(6) An expression vector comprising the gene according to any one of (1) to (5).
(7) A transformant, into which the gene according to any one of (1) to (5) has been introduced.
(8) The transformant according to (7), which is obtained using *Escherichia coli* or yeast as a host.
(9) A protein encoded by the gene according to any one of (1) to (5).
(10) A method for producing a hydrocarbon, comprising allowing a protein encoded by the gene according to any one of (1) to (5), a coenzyme which is involved in the activity of the protein of synthesizing a hydrocarbon with a carbon number one less than that of an aldehyde compound from the aldehyde compound, and an aldehyde compound that serves as a substrate for the activity of the protein to coexist so as to synthesize a hydrocarbon with a carbon number one less than that of the aldehyde compound.
(11) The method for producing a hydrocarbon according to (10), wherein the protein, the coenzyme, and the aldehyde compound are allowed to coexist by culturing a transformant into which the gene according to any one of (1) to (5) has been introduced in a solution containing the aldehyde compound.
(12) The method for producing a hydrocarbon according to (10), wherein the protein, the coenzyme, and the aldehyde compound are allowed to coexist by mixing an enzyme liquid extracted from a transformant into which the gene according to any one of (1) to (5) has been introduced with a solution containing the aldehyde compound.
(13) The method for producing a hydrocarbon according to (10), wherein the protein, the coenzyme, and the aldehyde compound are allowed to coexist by mixing the protein isolated from a transformant into which the gene according to any one of (1) to (5) has been introduced with a solution containing the aldehyde compound and the coenzyme.
(14) The method for producing a hydrocarbon according to (10), wherein the aldehyde compound is a $C_{11}$-$C_{21}$ aldehyde compound.
(15) The method for producing a hydrocarbon according to (10), wherein the coenzyme is reduced nicotinamide adenine dinucleotide (NADH).

This specification includes part or all of the contents as disclosed in the specification and/or drawings of Japanese Patent Application No. 2012-040141, which is a priority document of the present application.

Advantageous Effects of Invention

According to the present invention, a hydrocarbon synthase gene having activity of converting an aldehyde compound into a hydrocarbon with a carbon number one less than that of the aldehyde compound superior to that of conventionally known aldehyde decarbonylase genes can be provided. A hydrocarbon can be produced using an aldehyde compound as a substrate with good efficiency at low cost by making use of the hydrocarbon synthase gene of the present invention.

BRIEF DESCRIPTION OF DRAWINGS

FIG. 10-1 is the first half of a characteristic chart showing results of determining "activity of synthesizing a hydrocarbon with a carbon number one less than that of an aldehyde compound from the aldehyde compound" for transformants prepared using 53 types of genes from a variety of organism species.

FIG. 10-2 is the second half of a characteristic chart showing results of determining "activity of synthesizing a hydrocarbon with a carbon number one less than that of an aldehyde compound from the aldehyde compound" for transformants prepared using 53 types of genes from a variety of organism species.

DESCRIPTION OF EMBODIMENTS

Figure 1:
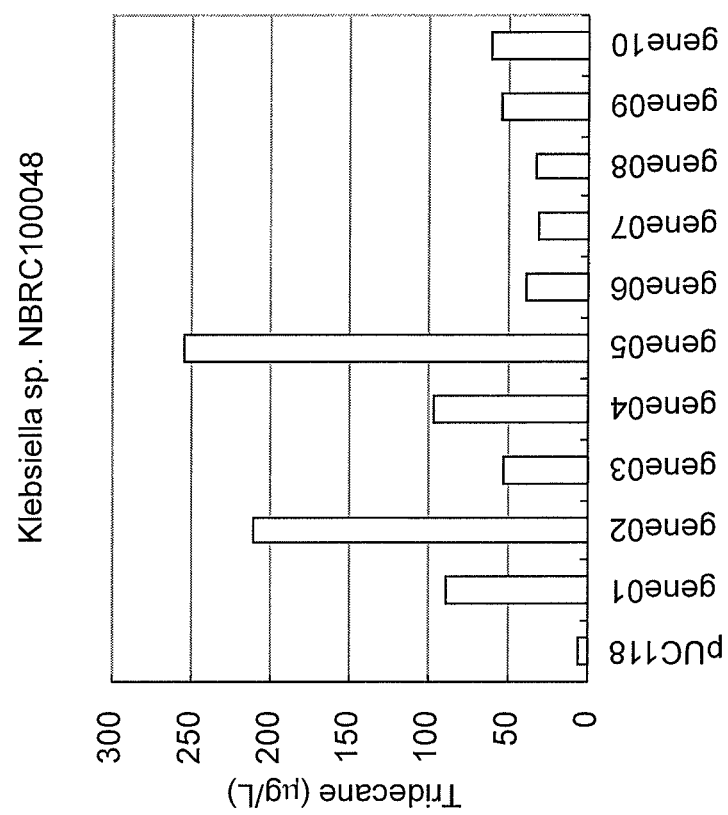
FIG. 1 is a characteristic chart showing results of determining "activity of synthesizing a hydrocarbon with a carbon number one less than that of an aldehyde compound from the aldehyde compound" for transformants prepared using 10 types of genes from *Klebsiella* sp.

The present invention is described in more detail below with reference to the drawings and the Examples.

The hydrocarbon synthesis gene of the present invention is a gene encoding a protein comprising an amino acid sequence comprising a motif sequence shown in SEQ ID NO: 1 and having "activity of synthesizing a hydrocarbon with a carbon number one less than that of an aldehyde compound from the aldehyde compound (hereinafter referred to as "hydrocarbon synthesis activity")." The term "hydrocarbon synthesis activity" refers to an enzyme activity of synthesizing a hydrocarbon with a carbon number one less than that of an aldehyde compound from the aldehyde compound, which also can be said as enzyme activity of removing a carbonyl group from an aldehyde compound. The hydrocarbon synthesis activity may include a reaction for generating, as by-products, carbon monoxide, carbon dioxide, carbonic acid, formic acid, water, and the like.

Here, the motif sequence shown in SEQ ID NO: 1 is a sequence referred to as an aldehyde dehydrogenases glutamic acid active site. In the amino acid sequence shown in SEQ ID NO: 1, the 1st Xaa corresponds to an amino acid single letter code of L, I, V, M, F, G, or A. The 3rd Xaa corresponds to an amino acid single letter code of L, I, M, S, T, A, or C in the amino acid sequence shown in SEQ ID NO: 1. The 4th Xaa corresponds to an amino acid single letter code of G or S in the amino acid sequence shown in SEQ ID NO: 1. The 6th Xaa corresponds to an amino acid single letter code of K, N, L, or M in the amino acid sequence shown in SEQ ID NO: 1. The 7th Xaa corresponds to an amino acid single letter code of S, A, D, or N in the amino acid sequence shown in SEQ ID NO: 1. The 8th Xaa corresponds to an amino acid single letter code of T, A, P, F, or V in the amino acid sequence shown in SEQ ID NO: 1.

Particularly preferably, the hydrocarbon synthesis gene of the present invention is a gene encoding a protein having hydrocarbon synthesis activity and comprising an amino acid sequence further comprising the motif sequence shown in SEQ ID NO: 2 on the C-terminal side of the motif sequence shown in SEQ ID NO: 1. Here, the motif sequence shown in SEQ ID NO: 2 corresponds to the amino acid sequence of a region that is found to be highly conserved upon multiple alignment analysis of amino acid sequences of a plurality of proteins encoded by a gene from a Klebsiella sp. microorganism which is the hydrocarbon synthesis gene of the present invention. The first Xaa corresponds to an amino acid single letter code of P, A, or F in the amino acid sequence shown in SEQ ID NO: 2. In addition, the 2nd Xaa corresponds to an amino acid single letter code of F, H, or V in the amino acid sequence shown in SEQ ID NO: 2. Further, the 3rd Xaa corresponds to an amino acid single letter code of G or A in the amino acid sequence shown in SEQ ID NO: 2. The 5th Xaa may correspond to any amino acid in the amino acid sequence shown in SEQ ID NO: 2. The 6th Xaa corresponds to an amino acid single letter code of K, G, or R in the amino acid sequence shown in SEQ ID NO: 2. The 7th Xaa may correspond to any amino acid in the amino acid sequence shown in SEQ ID NO: 2. The 10th Xaa may correspond to any amino acid in the amino acid sequence shown in SEQ ID NO: 2. The 11th Xaa corresponds to an amino acid single letter code of G or H in the amino acid sequence shown in SEQ ID NO: 2. The 12th Xaa corresponds to an amino acid single letter code of R, K, or G in the amino acid sequence shown in SEQ ID NO: 2. The 13th Xaa corresponds to an amino acid single letter code of F, D, P, or A in the amino acid sequence shown in SEQ ID NO: 2.

Further, the hydrocarbon synthesis gene of the present invention may be a gene from any organism. For example, the hydrocarbon synthesis gene of the present invention can be identified/isolated from a Gram-negative organism, a Gram-positive organism, a fungus, a plant, or an animal. Examples of a Gram-negative organism include *Escherichia coli* and *Pseudomonas putida*. Examples of a Gram-positive organism include *Bacillus subtilis, Corynebacterium glutamicum*, and *Lactobacillus reuteri*. Examples of a fungus include *Saccharomyces cerevisiae, Candida tropicalis, Debaryomyces hansenii, Pichia pastoris*, and *Aspergillus oryzae*. Examples of a plant include *Zea mays* and *Arabidopsis thaliana*. Examples of an animal include *Drosophila melanogaster, Rattus norvegicus*, and *Homo sapiens*. The hydrocarbon synthesis gene of the present invention can be isolated from such various organisms and used in an adequate manner.

More specifically, an aldehyde dehydrogenase gene encoding a protein comprising the motif sequence shown in SEQ ID NO: 1 can be searched for in a database storing gene information such as the NCBI (National Center for Biotechnology Information) database. The target gene can be identified based on the corresponding accession number as described below.

Specifically, *Escherichia coli* K-12 W3110-derived genes, i.e., BAE77705, BAA35791, BAA14869, BAA14992, BAA15032, BAA16524, BAE77705, BAA15538, and BAA15073, can be identified as the hydrocarbon synthesis gene of the present invention. In addition, *Pseudomonas putida*_F1-derived genes, i.e., YP_001268218, YP_001265586, YP_001267408, YP_001267629, YP_001266090, YP_001270490, YP_001268439, YP_001267367, YP_001267724, YP_001269548, YP_001268395, YP_001265936, YP_001270470, YP_001266779, and YP_001270298, can be identified as the hydrocarbon synthesis gene of the present invention.

In addition, genes from the *Bacillus subtilis* 168 strain, i.e., NP_388129, NP_389813, NP_390984, NP_388203, NP_388616, NP_391658, NP_391762, NP_391865, and NP_391675, can be identified as the hydrocarbon synthesis gene of the present invention. *Corynebacterium glutamicum* ATCC13032-derived genes, i.e., NP_599351, NP_599725, NP_601988, NP_599302, NP_601867, and NP_601908, can be identified as the hydrocarbon synthesis gene of the present invention. A *Lactobacillus reuteri* DSM20016-derived gene, i.e., YP_001270647, can be identified as a hydrocarbon synthesis gene according to the present invention.

Further, *Saccharomyces cerevisiae*-derived genes, i.e., NP_010996, NP_011904, NP_015264, NP_013828, NP_009560, NP_015019, NP_013893, NP_013892, and NP_011902, can be identified as the hydrocarbon synthesis gene of the present invention. *Candida tropicalis* MYA-3404-derived genes, i.e., XP_002548035, XP_002545751, XP_002547036, XP_002547030, XP_002550712, XP_002547024, XP_002550173, XP_002546610, and XP_002550289, can be identified as the hydrocarbon synthesis gene of the present invention. *Debaryomyces hansenii* CBS767-derived genes, i.e., XP_460395, XP_457244, XP_457404, XP_457750, XP_461954, XP_462433, XP_461708, and XP_462528, can be identified as the hydrocarbon synthesis gene of the present invention. *Pichia*

*pastoris* GS115-derived genes, i.e., XP_002489360, XP_002493450, XP_002491418, XP_002493229, XP_002490175, XP_002491360, and XP_002491779, can be identified as the hydrocarbon synthesis gene of the present invention. *Schizosaccharomyces pombe*-derived genes, i.e., NP_593172, NP_593499, and NP_594582 can be identified as hydrocarbon synthesis genes according to the present invention. *Aspergillus oryzae* RIB40-derived genes, i.e., XP_001822148, XP_001821214, XP_001826612, XP_001817160, XP_001817372, XP_001727192, XP_001826641, XP_001827501, XP_001825957, XP_001822309, XP_001727308, XP_001818713, XP_001819060, XP_001823047, XP_001817717, and XP_001821011, can be identified as the hydrocarbon synthesis gene of the present invention.

Furthermore, *Zea mays*-derived genes, i.e., NP_001150417, NP_001105047, NP_001147173, NP_001169123, NP_001105781, NP_001157807, NP_001157804, NP_001105891, NP_001105046, NP_001105576, NP_001105589, NP_001168661, NP_001149126, and NP_001148092 can be identified as the hydrocarbon synthesis gene of the present invention. *Arabidopsis thaliana*-derived genes, i.e., NP_564204, NP_001185399, NP_178062, NP_001189589, NP_566749, NP_190383, NP_187321, NP_190400, NP_001077676, and NP_175812, can be identified as the hydrocarbon synthesis gene of the present invention.

Moreover, *Drosophila melanogaster*-derived genes, i.e., NP_733183, NP_609285, NP_001014665, NP_649099, NP_001189159, NP_610285, and NP_610107 can be identified as the hydrocarbon synthesis gene of the present invention. *Rattus norvegicus*-derived genes, i.e., NP_001006999, XP_001067816, XP_001068348, XP_001068253, NP_113919, XP_001062926, NP_071609, NP_071852, NP_058968, NP_001011975, NP_115792, NP_001178017, NP_001178707, NP_446348, NP_071992, XP_001059375, XP_001061872, and NP_001128170 can be identified as the hydrocarbon synthesis gene of the present invention. *Homo sapiens*-derived genes, i.e., NP_036322, NP_001193826, NP_001029345, NP_000684, NP_000680, NP_000683, NP_000681, NP_001071, NP_000687, NP_001180409, NP_001173, NP_000682, NP_000373, NP_001154976, NP_000685, and NP_000686, can be identified as the hydrocarbon synthesis gene of the present invention.

Meanwhile, the aforementioned gene encoding a protein comprising the motif sequence shown in SEQ ID NO: 1 can be identified based on the genome sequence information obtained by elucidating the genome sequence of an organism with an unknown genome sequence that is not registered in a database such as the NCBI database. More specifically, when the genome sequence of the *Klebsiella* sp. NBRC100048 strain is analyzed according to a standard method, the gene encoding a protein comprising the motif sequence shown in SEQ ID NO: 1 can be identified based on the genome sequence information.

Ten types of genes can be identified as hydrocarbon synthesis genes from *Klebsiella* sp. according to the present invention. These ten different genes are designated as gene01 to gene10 for convenience. Table 1 below lists nucleotide sequences of the coding regions of gene01 to gene10 and amino acid sequences encoded by the nucleotide sequences.

TABLE 1

| Gene name | Nucleotide sequence | Amino acid sequence |
| --- | --- | --- |
| gene01 | SEQ ID NO: 3 | SEQ ID NO: 4 |
| gene02 | SEQ ID NO: 5 | SEQ ID NO: 6 |
| gene03 | SEQ ID NO: 7 | SEQ ID NO: 8 |
| gene04 | SEQ ID NO: 9 | SEQ ID NO: 10 |
| gene05 | SEQ ID NO: 11 | SEQ ID NO: 12 |
| gene06 | SEQ ID NO: 13 | SEQ ID NO: 14 |
| gene07 | SEQ ID NO: 15 | SEQ ID NO: 16 |
| gene08 | SEQ ID NO: 17 | SEQ ID NO: 18 |
| gene09 | SEQ ID NO: 19 | SEQ ID NO: 20 |
| gene10 | SEQ ID NO: 21 | SEQ ID NO: 22 |

The genes from *Klebsiella* sp. listed in table 1 encode proteins comprising the motif sequence shown in SEQ ID NO: 2.

Table 2 below lists the nucleotide sequences of the coding regions and amino acid sequences encoded by the nucleotide sequences for 5 types of *Escherichia coli* K-12 W3110-derived genes, i.e., BAA14869, BAA14992, BAA16524, BAE77705, and BAA15538, as examples of genes registered with the NCBI database.

TABLE 2

| Gene name | Nucleotide sequence | Amino acid sequence |
| --- | --- | --- |
| BAA14869 | SEQ ID NO: 23 | SEQ ID NO: 24 |
| BAA14992 | SEQ ID NO: 25 | SEQ ID NO: 26 |
| BAA16524 | SEQ ID NO: 27 | SEQ ID NO: 28 |
| BAE77705 | SEQ ID NO: 29 | SEQ ID NO: 30 |
| BAA15538 | SEQ ID NO: 31 | SEQ ID NO: 32 |

Table 3 below lists the nucleotide sequences of the coding regions and amino acid sequences encoded by the nucleotide sequences for *Corynebacterium glutamicum* ATCC13032-derived genes, a *Lactobacillus reuteri* DSM20016-derived gene, *Saccharomyces cerevisiae*-derived genes, *Candida tropicalis* MYA-3404-derived genes, *Debaryomyces hansenii* CBS767-derived genes, *Pichia pastoris* GS115-derived genes, *Schizosaccharomyces pombe*-derived genes, *Aspergillus oryzae* RIB40-derived genes, a *Zea mays*-derived gene, *Arabidopsis thaliana*-derived genes, *Drosophila melanogaster*-derived genes, *Rattus norvegicus*-derived genes, and *Homo sapiens*-derived genes, as examples of the hydrocarbon synthesis genes of the present invention registered with the NCBI database. Here, the "Gene name" column in table 3 contains gene IDs in the Kyoto Encyclopedia of Genes and Genomes (KEGG) database.

TABLE 3

| Organism species | Accession No. | Gene name | Nucleotide sequence | Ammo acid sequence |
| --- | --- | --- | --- | --- |
| *Corynebacterium glutamicum* ATCC13032 | NP_599351 | NCgl0098 | SEQ ID NO: 65 | SEQ ID NO: 66 |
| | NP_599725 | NCgl0463 | SEQ ID NO: 67 | SEQ ID NO: 68 |
| | NP_601988 | NCgl2698 | SEQ ID NO: 69 | SEQ ID NO: 70 |
| | NP_599302 | NCgl0049 | SEQ ID NO: 71 | SEQ ID NO: 72 |
| | NP_601867 | NCgl2578 | SEQ ID NO: 73 | SEQ ID NO: 74 |
| | NP_601908 | NCgl2619 | SEQ ID NO: 75 | SEQ ID NO: 76 |

TABLE 3-continued

| Organism species | Accession No. | Gene name | Nucleotide sequence | Amino acid sequence |
|---|---|---|---|---|
| Lactobacillus reuteri DSM20016 | YP_001270647 | Lreu_0034 | SEQ ID NO: 77 | SEQ ID NO: 78 |
| Saccharomyces cerevisiae | NP_010996 | YER073W | SEQ ID NO: 79 | SEQ ID NO: 80 |
|  | NP_011902 | YHR037W | SEQ ID NO: 81 | SEQ ID NO: 82 |
|  | NP_011904 | YHR039C | SEQ ID NO: 83 | SEQ ID NO: 84 |
|  | NP_013892 | YMR169C | SEQ ID NO: 85 | SEQ ID NO: 86 |
|  | NP_013893 | YMR170C | SEQ ID NO: 87 | SEQ ID NO: 88 |
|  | NP_015019 | YOR374W | SEQ ID NO: 89 | SEQ ID NO: 90 |
|  | NP_009560 | YBR006W | SEQ ID NO: 91 | SEQ ID NO: 92 |
|  | NP_013828 | YMR110C | SEQ ID NO: 93 | SEQ ID NO: 94 |
|  | NP_015264 | YPL061W | SEQ ID NO: 95 | SEQ ID NO: 96 |
| Candida tropicalis MYA-3404 | XP_002550289 | CTRG_04587 | SEQ ID NO: 97 | SEQ ID NO: 98 |
|  | XP_002547036 | CTRG_01342 | SEQ ID NO: 99 | SEQ ID NO: 100 |
|  | XP_002545751 | CTRG_00532 | SEQ ID NO: 101 | SEQ ID NO: 102 |
| Debaryomyces hansenii CBS767 | XP_461708 | DEHA2G03740g | SEQ ID NO: 103 | SEQ ID NO: 104 |
|  | XP_462528 | DEHA2G22572g | SEQ ID NO: 105 | SEQ ID NO: 106 |
|  | XP_457404 | DEHA2B10384g | SEQ ID NO: 107 | SEQ ID NO: 108 |
| Pichia pastoris GS115 | XP_002489360 | PAS_chr1-3_0024 | SEQ ID NO: 109 | SEQ ID NO: 110 |
|  | XP_002491418 | PAS_chr2-1_0853 | SEQ ID NO: 111 | SEQ ID NO: 112 |
|  | XP_002493450 | PAS_chr4_0043 | SEQ ID NO: 113 | SEQ ID NO: 114 |
| Schizosaccharomyces pombe | NP_593172 | SPAC139.05 | SEQ ID NO: 115 | SEQ ID NO: 116 |
|  | NP_593499 | SPAC1002.12c | SEQ ID NO: 117 | SEQ ID NO: 118 |
|  | NP_594582 | SPAC9E9.09c | SEQ ID NO: 119 | SEQ ID NO: 120 |
| Aspergillus oryzae RIB40 | XP_001821214 | AOR_1_1204144 | SEQ ID NO: 121 | SEQ ID NO: 122 |
|  | XP_001822148 | AOR_1_1330014 | SEQ ID NO: 123 | SEQ ID NO: 124 |
| Zea mays | NP_001150417 | LOC100284047 | SEQ ID NO: 125 | SEQ ID NO: 126 |
| Arabidopsis thaliana | NP_564204 | AT1G23800 | SEQ ID NO: 127 | SEQ ID NO: 128 |
|  | NP_001185399 | AT1G74920 | SEQ ID NO: 129 | SEQ ID NO: 130 |
|  | NP_178062 | AT1G79440 | SEQ ID NO: 131 | SEQ ID NO: 132 |
|  | NP_001189589 | AT2G24270 | SEQ ID NO: 133 | SEQ ID NO: 134 |
|  | NP_566749 | AT3G24503 | SEQ ID NO: 135 | SEQ ID NO: 136 |
|  | NP_190383 | AT3G48000 | SEQ ID NO: 137 | SEQ ID NO: 138 |
|  | NP_175812 | AT1G54100 | SEQ ID NO: 139 | SEQ ID NO: 140 |
| Drosophila melanogaster | NP_609285 | Dmel_CG3752 | SEQ ID NO: 141 | SEQ ID NO: 142 |
|  | NP_001189159 | Dmel_CG7145 | SEQ ID NO: 143 | SEQ ID NO: 144 |
|  | NP_610107 | Dmel_CG8665 | SEQ ID NO: 145 | SEQ ID NO: 146 |
|  | NP_610285 | Dmel_CG11140 | SEQ ID NO: 147 | SEQ ID NO: 148 |
|  | NP_733183 | Dmel_CG31075 | SEQ ID NO: 149 | SEQ ID NO: 150 |
|  | NP_001014665 | Dmel_CG4685 | SEQ ID NO: 151 | SEQ ID NO: 152 |
|  | NP_649099 | Dmel_CG9629 | SEQ ID NO: 153 | SEQ ID NO: 154 |
| Rattus norvegicus | NP_071852 | 24188 | SEQ ID NO: 155 | SEQ ID NO: 156 |
|  | NP_001128170 | 641316 | SEQ ID NO: 157 | SEQ ID NO: 158 |
| Homo sapiens | NP_000680 | 216 | SEQ ID NO: 159 | SEQ ID NO: 160 |
|  | NP_000683 | 219 | SEQ ID NO: 161 | SEQ ID NO: 162 |
|  | NP_000687 | 223 | SEQ ID NO: 163 | SEQ ID NO: 164 |
|  | NP_000373 | 224 | SEQ ID NO: 165 | SEQ ID NO: 166 |
|  | NP_001173 | 501 | SEQ ID NO: 167 | SEQ ID NO: 168 |
|  | NP_001180409 | 64577 | SEQ ID NO: 169 | SEQ ID NO: 170 |

Note that the hydrocarbon synthesis gene of the present invention is not limited to genes identified based on the gene names, the nucleotide sequences, and the amino acid sequences described above.

The hydrocarbon synthesis gene of the present invention may be a gene encoding a protein having hydrocarbon synthesis activity and comprising an amino acid sequence derived from the amino acid sequence shown in any even-numbered sequence ID number of SEQ ID NOS: 3 to 32 and 65 to 170 by substitution, deletion, insertion, or addition of one or a plurality of amino acids. The expression "a plurality of amino acids" used herein means, for example, 2 to 100 amino acids, preferably 2 to 80 amino acids, more preferably 2 to 50 amino acids, and further preferably 2 to 15 amino acids.

In addition, the hydrocarbon synthesis gene of the present invention may be a gene encoding a protein having hydrocarbon synthesis activity and comprising an amino acid sequence having 70% or more, preferably 80% or more, more preferably 85% or more, further preferably 90% or more, and most preferably 98% or more identity to an amino acid sequence shown in any even-numbered sequence ID number of SEQ ID NOS: 3 to 32 and 65 to 170. Here, identity between sequences refers to a value (percentage) of alignment between two amino acid sequences determined using sequence similarity search software such as BLAST, PSI-BLAST, or HMMER at a default setting.

Further, the hydrocarbon synthesis gene of the present invention may be a gene encoding a protein having hydrocarbon synthesis activity which is encoded by a polynucleotide that hybridizes under stringent conditions to at least a portion of a polynucleotide comprising a sequence complementary to a nucleotide sequence shown in any odd-numbered sequence ID number of SEQ ID NOS: 3 to 32 and 65 to 170. Here, the term "stringent conditions" refers to conditions under which namely a specific hybrid is formed, but a non-specific hybrid is never formed. For example, such conditions can be adequately determined with reference to Molecular Cloning: A Laboratory Manual (Third Edition). In practice, stringency can be predetermined based on the temperature and the salt concentration in a solution upon Southern hybridization, and the temperature and the salt concentration in a solution in the step of washing during Southern hybridization. Specifically, stringent conditions include, for example, a sodium concentration of 25 to 500 mM and preferably 25 to 300 mM, and a temperature of 42° C. to 68° C. and preferably 42° C. to 65° C. More specifically, stringent conditions include 5×SSC (83 mM NaCl, 83 mM sodium citrate) and a temperature of 42° C. In addition, the expression "at least a portion of a polynucleotide" means the entire polynucleotide comprising a nucleotide sequence complementary to a certain nucleotide sequence and a continuous portion of the entire polynucleotide comprising the complementary nucleotide sequence.

In addition, it is possible to introduce a mutation into a certain amino acid sequence by altering the nucleotide sequence of the above hydrocarbon synthesis gene by a technique known in the art. It is also possible to introduce a mutation into a nucleotide sequence by a known technique such as the Kunkel method or Gapped duplex method or a method according thereto. For example, a mutation is introduced using a mutagenesis kit using site-directed mutagenesis (e.g., Mutant-K and Mutant-G (both are commercial names, TAKARA Bio)) or an LA PCR in vitro Mutagenesis series kit (trade name, TAKARA Bio). Also, a mutagenesis method may be a method using a chemical mutagen represented by EMS (ethyl methanesulfonate), 5-bromouracil, 2-aminopurine, hydroxylamine, N-methyl-N'-nitro-N nitrosoguanidine, or other carcinogenic compounds or a method that involves radiation treatment or ultraviolet treatment typically using X-rays, alpha rays, beta rays, gamma rays, an ion beam, or the like.

It is possible to confirm whether or not a gene comprising a certain nucleotide sequence encodes a protein having hydrocarbon synthesis activity in the following manner. An expression vector incorporating the gene between, for example, an appropriate promoter and an appropriate terminator is produced, an appropriate host is transformed using the expression vector, and hydrocarbon synthesis activity of a protein to be expressed is assayed. Here, it is possible to assay hydrocarbon synthesis activity in the following manner. The above transformant is cultured using a solution containing an aldehyde compound that serves as a substrate. Then, a hydrocarbon from the aldehyde compound (i.e., a hydrocarbon with a carbon number one less than that of the aldehyde compound serving as a substrate) is analyzed using a gas chromatography system/mass spectrometer. In addition, quantitative assay of hydrocarbon synthesis activity can be carried out by quantitatively determining generated hydrocarbon using a gas chromatography system/mass spectrometer. As an aldehyde compound described in detail below, for example, tetradecanal can be used.

The hydrocarbon synthesis gene of the present invention described above is incorporated into an appropriate expression vector so as to be introduced into a host. The host used herein is not particularly limited as long as it is an organism that can express the hydrocarbon synthesis gene of the present invention. Examples of such host include: bacteria belonging to the genus *Escherichia* such as *Escherichia coli*; bacteria belonging to the genus *Bacillus* such as *Bacillus subtilis*; bacteria belonging to the genus *Pseudomonas* such as *Pseudomonas putida*; bacteria belonging to the genus *Rhizobium* such as *Rhizobium melilotii*; yeast such as *Saccharomyces cerevisiae, Schizosaccharomyces pombe*, or *Pichia pastoris*; and fungi such as filamentous bacteria.

When a bacterium such as *Escherichia coli* is used as a host, it is preferable for an expression vector to be autonomously replicable in the bacterium, and at the same time, to be composed of promoters, a ribosome-binding sequence, the above gene, and a transcription termination sequence. Such expression vector may further comprise a gene that controls promoter activity.

Examples of *Escherichia coli* that can be used include conventionally known bacterial strains such as the *Escherichia coli* BL21 (DE3), K12, DH1, and JM109 strains. Specifically, so-called K strains such as the K12 strain and a strain produced from the K12 strain can be used as *Escherichia coli*. In addition, the *Bacillus subtilis* 168 strain and the like can be used as *Bacillus subtilis*.

Any promoter can be used as long as it can be expressed in a host such as *Escherichia coli*. Examples of a promoter that can be used include: *Escherichia coli*-derived promoters such as a trp promoter, a lac promoter, a PL promoter, and a PR promoter; and phage-derived promoters such as a T7 promoter. Alternatively, an artificially designed or modified promoter such as a tac promoter may be used.

A method for introducing an expression vector is not particularly limited as long as DNA is introduced into a bacterium. Examples of the method include a method using calcium ions [Cohen, S, N., et al.: Proc. Natl. Acad. Sci., USA, 69:2110-2114 (1972)] and electroporation.

Examples of yeast that can be used as a host include, but are not particularly limited to, yeast belonging to the genus *Candida* such as *Candida Shehatae*, yeast belonging to the genus *Pichia* such as *Pichia stipitis*, yeast belonging to the genus *Pachysolen* such as *Pachysolen tannophilus*, yeast belonging to the genus *Saccharomyces* such as *Saccharomyces cerevisiae*, and yeast belonging to the genus *Schizosaccharomyces* such as *Schizosaccharomyces pombe*. *Saccharomyces cerevisiae* is particularly preferable.

In addition, in order to enhance expression of the hydrocarbon synthesis gene of the present invention, an appropriate promoter having high transcription activity is used. Examples of such promoter that can be used include, but are not particularly limited to, a glyceraldehyde-3-phosphate dehydrogenase gene (TDH3) promoter, a 3-phosphoglycerate kinase gene (PGK1) promoter, and a hyperosmolarity-responsive 7 gene (HOR7) promoter. A pyruvate decarboxylase gene (PDC1) promoter is particularly preferable because it has high capacity to cause high expression of a gene of interest located downstream of the promoter. In addition to the above, a downstream gene can be strongly expressed using a gal1 promoter, a gal10 promoter, a heat shock protein promoter, an MFα1 promoter, a PHO5 promoter, a GAP promoter, an ADH promoter, an AOX1 promoter, or the like.

In addition, as a method for introducing the above gene, any conventionally known method of yeast transformation can be used. Specific examples of such method that can be carried out include, but are not limited to, an electroporation method (Meth. Enzym., 194, p. 182 (1990)), a spheroplast method (Proc. Natl. Acad. Sci. USA, 75 p. 1929 (1978)), and a lithium acetate method (J. Bacteriology, 153, p. 163 (1983), Proc. Natl. Acad. Sci. USA, 75 p. 1929 (1978), Methods in yeast genetics, 2000 Edition: A Cold Spring Harbor Laboratory Course Manual).

As described above, a recombinant organism into which the hydrocarbon synthesis gene of the present invention has been introduced (e.g., recombinant *Escherichia coli* or recombinant yeast) can synthesize a hydrocarbon from an aldehyde compound if the hydrocarbon synthesis gene is expressed in the presence of the aldehyde compound and a coenzyme such as NADH. For synthesis, NADH can be used as a coenzyme that allows a protein encoded by the hydrocarbon synthesis gene of the present invention to show hydrocarbon synthesis activity. Since NADH is abundantly present in cells, the amount of coenzyme would not be a rate-determining factor of a hydrocarbon synthesis reaction. Therefore, a recombinant organism into which the hydrocarbon synthesis gene of the present invention has been introduced (e.g., recombinant *Escherichia coli* or recombinant yeast) can synthesize a hydrocarbon with excellent reaction efficiency. Either of NADH and NADPH can be used as a coenzyme for a protein encoded by the hydrocarbon synthesis gene of the present invention.

Hydrocarbons that can be synthesized herein include hydrocarbons having chain structures (chain hydrocarbons) and hydrocarbons having cyclic structures (cyclic hydrocarbons). Hydrocarbons having chain structures may have one or more branches. Examples of branches include: an alkyl group such as a methyl group, an ethyl group, a propyl group, or a butyl group (including a tert-butyl group); an alkynyl group; and an alkenyl group. Also, examples of branches include a chloromethyl group, an acetyl group, a 2-pyridyl group, a hydroxyphenyl group, an aminoacetyl group, a methoxy group, a phenoxy group, a methylthio group, and a phenylthio group. Further, a hydrocarbon to be synthesized may be a saturated hydrocarbon (alkane) or an unsaturated hydrocarbon (alkene or alkyne).

Meanwhile, the number of carbons for a hydrocarbon to be synthesized is not particularly limited; however, it is preferably 5 to 20 so that the hydrocarbon is in a liquid form at ordinary temperatures. In addition, the hydrocarbon to be synthesized is preferably a $C_{10}$-$C_{20}$ saturated hydrocarbon in consideration of the use thereof for diesel fuel, more preferably a $C_{12}$-$C_{14}$ saturated hydrocarbon, and most preferably a $C_{13}$ saturated hydrocarbon. More specifically, the hydrocarbon to be synthesized is $C_{12}$ dodecane, $C_{13}$ tridecane, $C_{14}$ tetradecane, or the like.

When specific hydrocarbons such as those listed above are synthesized, an appropriate aldehyde compound that serves as a substrate can be selected. That is, since hydrocarbon synthesis activity causes synthesis of a hydrocarbon from an aldehyde compound used as a substrate, an appropriate aldehyde compound can be selected in accordance with the structure of a desired hydrocarbon.

Meanwhile, the hydrocarbon synthesis gene of the present invention also can be used for a method for producing a hydrocarbon in vitro. In one example, a hydrocarbon can be synthesized in vitro using a disruption solution obtained by disrupting a recombinant organism into which the hydrocarbon synthesis gene of the present invention has been introduced (e.g., recombinant *Escherichia coli* or recombinant yeast) or an extract obtained by extracting a fraction containing a protein encoded by the hydrocarbon synthesis gene from the disruption solution. Specifically, in vitro hydrocarbon synthesis can be carried out by adding an aldehyde compound that serves as a substrate (and, if necessary, a coenzyme such as NADH) to the disruption solution or extract. In particular, the disruption solution or extract is rich in a coenzyme such as NADH, and thus it is only necessary to add an aldehyde compound that serves as a substrate to the disruption solution or extract (without the need of adding a coenzyme such as NADH) in most cases. In other words, the use of the hydrocarbon synthesis gene of the present invention enables efficient hydrocarbon synthesis without the need of an expensive coenzyme such as NADPH.

Alternatively, a hydrocarbon can be synthesized in vitro by purifying or roughly purifying a protein encoded by the hydrocarbon synthesis gene of the present invention according to a standard method and mixing the purified or roughly purified protein, an aldehyde compound that serves as a substrate, and a coenzyme such as NADH. Here, NADH can be used as a coenzyme for a protein encoded by the hydrocarbon synthesis gene of the present invention so that the protein shows hydrocarbon synthesis activity. Thus, it is not always necessary to use an expensive coenzyme, i.e., NADPH. This means that when a protein encoded by the hydrocarbon synthesis gene of the present invention is used, in vitro hydrocarbon synthesis can be achieved at low cost using NADH as a less expensive coenzyme.

A synthesized hydrocarbon can be isolated by a standard method. For example, the above-described recombinant yeast is cultured in a medium so as to produce a hydrocarbon. Here, a hydrocarbon is synthesized in a medium and thus it can be isolated from a supernatant fraction obtained by isolating cells from the medium by means of centrifugation or the like. For example, a hydrocarbon can be isolated from a supernatant fraction as follows. An organic solvent such as ethyl acetate or methanol is added to a supernatant fraction. The mixture is sufficiently agitated and separated into an aqueous layer and a solvent layer. Then, a hydrocarbon is extracted from the solvent layer.

EXAMPLES

The present invention is hereafter described in greater detail with reference to the following examples, although the technical scope of the present invention is not limited thereto.

Example 1

In this Example, the genome sequence of a microorganism having alkane synthesis capacity of the *Klebsiella* sp. NBRC100048 strain was analyzed by a standard method. Ten types of genes encoding proteins comprising the motif sequence shown in SEQ ID NO: 1 were identified based on the obtained genome sequence information. The 10 types of genes identified herein were designated as gene01 to gene10 and functions thereof were estimated. Table 4 summarizes information about putative functions and sequences of the ten different genes.

TABLE 4

| Gene name | Putative function | Nucleotide sequence | Amino acid sequence |
|---|---|---|---|
| gene01 | phenylacetaldehyde: NAD+ oxidoreductase | SEQ ID NO: 3 | SEQ ID NO: 4 |
| gene02 | phenylacetaldehyde: NAD+ oxidoreductase | SEQ ID NO: 5 | SEQ ID NO: 6 |
| gene03 | 4-aminobutanal: NAD+ 1-oxidoreductase | SEQ ID NO: 7 | SEQ ID NO: 8 |
| gene04 | aldehyde dehydrogenase | SEQ ID NO: 9 | SEQ ID NO: 10 |
| gene05 | succinate-semialdehyde: NAD+ oxidoreductase | SEQ ID NO: 11 | SEQ ID NO: 12 |
| gene06 | succinate-semialdehyde: NAD+ oxidoreductase | SEQ ID NO: 13 | SEQ ID NO: 14 |
| gene07 | betaine-aldehyde: NAD+ oxidoreductase | SEQ ID NO: 15 | SEQ ID NO: 16 |
| gene08 | N-succinyl-L-glutamate 5-semialdehyde: NAD+ oxidoreductase | SEQ ID NO: 17 | SEQ ID NO: 18 |

TABLE 4-continued

| Gene name | Putative function | Nucleotide sequence | Amino acid sequence |
|---|---|---|---|
| gene09 | (S)-lactaldehyde: NAD+ oxidoreductase | SEQ ID NO: 19 | SEQ ID NO: 20 |
| gene10 | betaine-aldehyde: NAD+ oxidoreductase | SEQ ID NO: 21 | SEQ ID NO: 22 |

In this Example, genes encoding proteins comprising the motif sequence shown in SEQ ID NO: 1 were identified based on the genome information of the *E. coli* W3110 strain, as well as the 10 types of genes. Particularly in this Example, 5 types of genes listed in Table 5 below were mainly examined from among the identified genes.

TABLE 5

| Gene name | Putative function | Nucleotide sequence | Amino acid sequence |
|---|---|---|---|
| BAA14869 | gamma-Glu-gamma-aminobutyraldehyde dehydrogenase. NAD(P)H-dependent | SEQ ID NO: 23 | SEQ ID NO: 24 |
| BAA14992 | phenylacetaldehyde dehydrogenase | SEQ ID NO: 25 | SEQ ID NO: 26 |
| BAA16524 | succinate-semialdehyde dehydrogenase, NADP-dependent | SEQ ID NO: 27 | SEQ ID NO: 28 |
| BAE77705 | aldehyde dehydrogenase B | SEQ ID NO: 29 | SEQ ID NO: 30 |
| BAA15538 | succinylglutamic semialdehyde dehydrogenase | SEQ ID NO: 31 | SEQ ID NO: 32 |

Nucleic acid fragments separately containing the above 15 types of genes were PCR-amplified using, as a template, genome DNA of the *Klebsiella* sp. NBRC100048 strain or the *E. coli* W3110 strain. Table 6 shows primers used for PCR. DNeasy Blood & Tissue Kits (QIAGEN) were used for genome DNA extraction.

TABLE 6

| Gene name | Forward primer | Sequence ID number | Reverse primer | Sequence ID number |
|---|---|---|---|---|
| gene04 | cggtacccggggatccCAATATGCCGCTGCGTCTCAACCCTACA | SEQ ID NO: 33 | cgactctagaggatccACCCGAATGGATTGCGGACTGAGGA | SEQ ID NO: 34 |
| gene01 | cggtacccggggatccATCTTGATGTTCATCGCGTTACCCT | SEQ ID NO: 35 | cgactctagaggatccCGATTAATATCGCACCATCACCGACTT | SEQ ID NO: 36 |
| gene02 | cggtacccggggatccCGCGATGAATAAGGAAAGGGTATGTCCA | SEQ ID NO: 37 | cgactctagaggatccAGATTGCCCTCCACAGTAGCGAGAA | SEQ ID NO: 38 |
| gene03 | cggtacccggggatccTGGTAACGACGATACCAATCTTAGGG | SEQ ID NO: 39 | cgactctagaggatccTGTGACTATTAGCGGCCTAACACAC | SEQ ID NO: 40 |
| gene05 | cggtacccggggatccAGTAGCGATTAACAAGGAGACATGCGA | SEQ ID NO: 41 | cgactctagaggatccCATGTGAGCGTTGACGGTAAAGAGG | SEQ ID NO: 42 |
| gene06 | cggtacccggggatccCCCCTGAAGACAGGAAGCAATTATGCAACTC | SEQ ID NO: 43 | cgactctagaggatccTCGCTCCTGTTAAAGGCCAATGCAC | SEQ ID NO: 44 |
| gene07 | cggtacccggggatccTATTCGTCAGCATTTACCGAACCCA | SEQ ID NO: 45 | cgactctagaggatccCCGGTTAAAATATGGACTGGAATTTACCC | SEQ ID NO: 46 |
| gene08 | cggtacccggggatccATCCCTGAGGAGAAAACTGCATGAGTCTGT | SEQ ID NO: 47 | cgactctagaggatccAAAGGAGAGCCCGGCGTAGTGATGG | SEQ ID NO: 48 |
| gene09 | cggtacccggggatccAGCCATGACAGCACCCGTTCAACAC | SEQ ID NO: 49 | cgactctagaggatccGTGCCTCAGGCCTGCAGATAGACCA | SEQ ID NO: 50 |
| gene10 | cggtacccggggatccGCATAACCGCAGAGAGGCTGAGATGGA | SCO ID NO: 51 | cgactctagaggatccCCCTTTCTCAGTCGCACCAGTGGT | SEQ ID NO: 52 |
| BAA14869 | cggtacccggggatccATCTGATAGACGTGAAACAGGA | SEQ ID NO: 53 | cgactctagaggatccGAGGCTTCGAGAACCACTAC | SEQ ID NO: 54 |
| BAA14992 | cggtacccggggatccTGTCACGATTTGCGGAGCTT | SEQ ID NO: 55 | cgactctagaggatccACCATGGAACTTCTTTGACGAAAC | SEQ ID NO: 56 |
| BAA16524 | cggtacccggggatccCTTTGAAAACAGGGATGTAGCGA | SEQ ID NO: 57 | cgactctagaggatccCCAGTTAAAGACCGATGCAC | SEQ ID NO: 58 |
| BAE77705 | cggtacccggggatccATACCTCACACCGCAAGGAG | SEQ ID NO: 59 | cgactctagaggatccCGACCAGCTTCTTATATCAGAACAG | SEQ ID NO: 60 |

A sequence for homologous recombination (i.e., a sequence homologous to a vector region) was added to each primer. PfuUltra II Fusion HS DNA Polymerase (Stratagene) was also used for PCR. Each PCR-amplified nucleic acid fragment was mixed with a BamHI-treated pUC118 plasmid so as to incorporate the amplified nucleic acid fragment into a vector by homologous recombination. QIAquick PCR Purification Kits (QIAGEN) were used for the purification of PCR products. In-Fusion HD Cloning Kits (Clontech) were used for the ligation of PCR products.

The obtained expression plasmids were used for the transformation of *E. coli* JM109. Each of *Escherichia coli* transformants was cultured overnight in 1-ml LB medium (ampicillin: 100 μg/ml) at 37° C. and 100 rpm. 3-ml LB medium (ampicillin: 100 μg/ml; Triton X-100:0.1%; IPTG: 0.5 mM; and tetradecanal: 1 mM) was inoculated with the obtained culture liquid to result in 10% culture liquid by volume, followed by culture at 30° C. and 100 rpm for 24 hours.

Cells were harvested from the culture product (room temperature, 6000×g, 5 min). The supernatant (1 ml) was introduced into a glass vial bottle (Agilent Technologies) and subjected to GC/MS analysis so as to detect tridecane synthesized from tetradecanal. An HP7694 Headspace Sampler (Hewlett-Packard) was used for GC/MS analysis. Table 7 shows Headspace Sampler analysis conditions and table 8 shows GC/MS analysis conditions.

TABLE 7

| Headspace Sampler: HP7694 (Hewlett-Packard) | | |
|---|---|---|
| Zone Temp | Oven | 90° C. |
| | Loop | 150° C. |
| | TR. Line | 200° C. |
| Event Time | GC cycle time | 8.5 min |
| | Vial EQ time | 8.5 min |
| | Pressuriz. time | 0.5 min |
| | Loop fill time | 0.2 min |
| | Loop EQ time | 0.2 min |
| | Inject time | 1.0 min |
| Vial Parameter | Shake | High |

TABLE 8

| <GC/MS analysis conditions> | |
|---|---|
| GC/MS: | HP6890/5973 (Hewlett-Packard) |
| Column: | HP-INNOWAX (Agilent: 19091N-213) |
| Inlet temperature: | 260° C. |
| Detector temperature: | 260° C. |
| Injection parameter split ratio: | 1/20 |
| Carrier gas: | Helium 3.0 ml/min |
| Oven heating conditions | 60° C. 1 min |
| Heating to 260° C. at 50° C./min | 260° C. 1 min |

Figure 2:
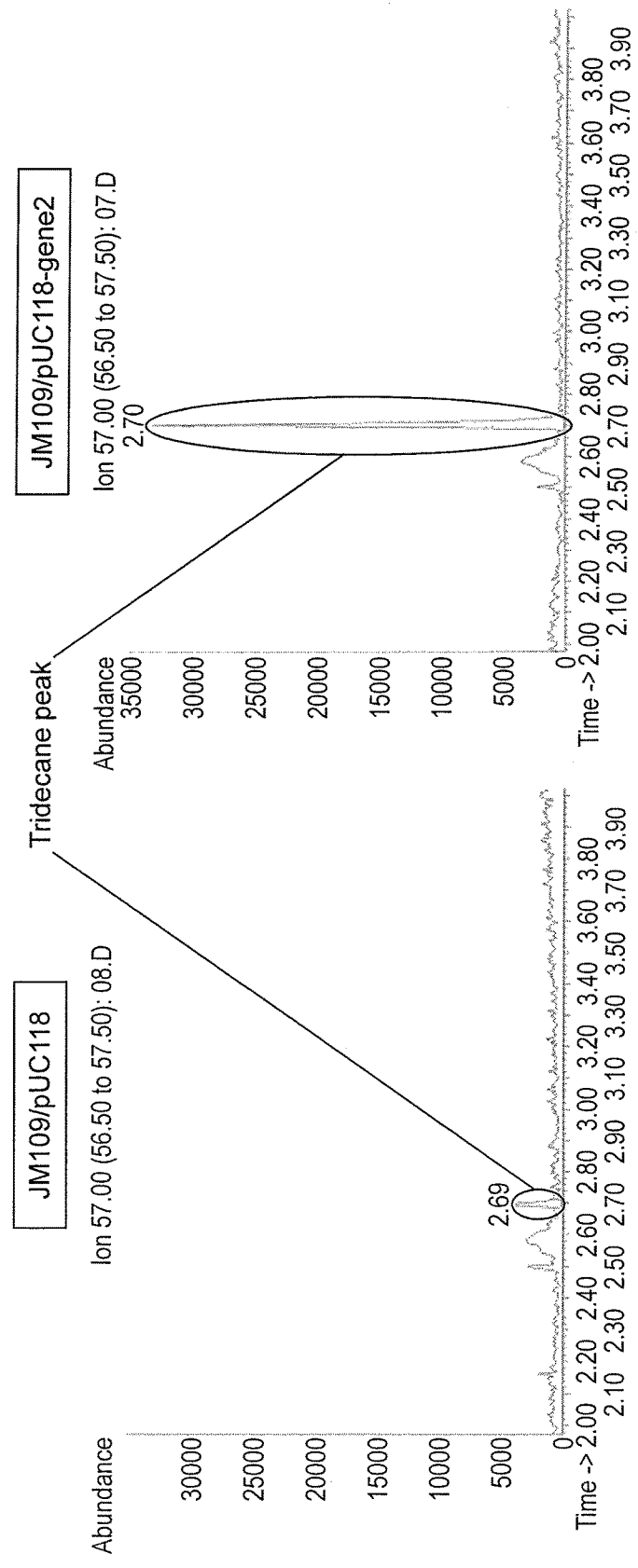
FIG. 2 shows a GC/MS analysis chart for a vector control strain and that for a strain into which gene02 has been introduced.

FIG. 1 shows analysis results obtained using the 10 types of genes from *Klebsiella* sp. identified in this Example. As shown in FIG. 1, all of the 10 types of genes from *Klebsiella* sp. identified in this Example were found to have hydrocarbon synthesis activity. In addition, proteins encoded by gene02 and gene05 were found to have significantly excellent hydrocarbon synthesis activity. FIG. 2 shows a GC/MS analysis chart for a vector control strain and that for a strain into which gene02 has been introduced.

Figure 3:
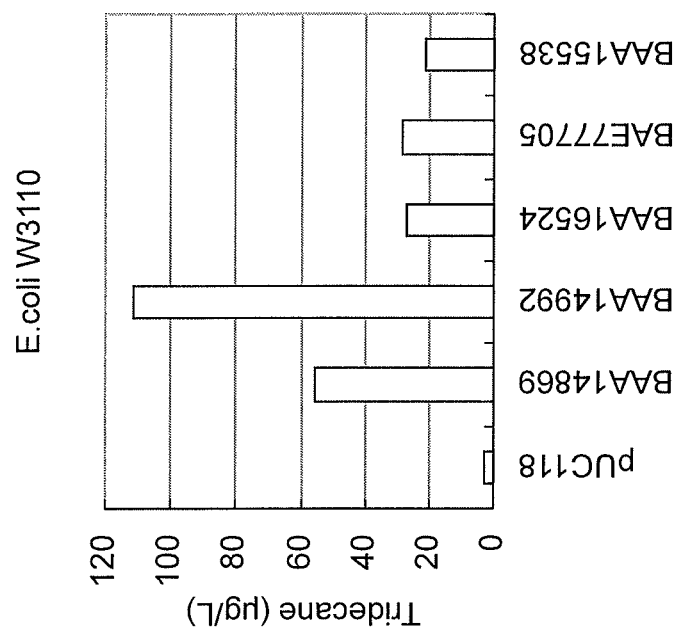
FIG. 3 is a characteristic chart showing results of determining "activity of synthesizing a hydrocarbon with a carbon number one less than that of an aldehyde compound from the aldehyde compound" for transformants prepared using 5 types of genes from the *E. coli* W3110 strain.

Similarly, FIG. 3 shows analysis results obtained using the 5 types of genes from the *E. coli* W3110 strain identified in this Example. As shown in FIG. 3, all of the 5 types of genes from the *E. coli* W3110 strain identified in this Example were found to have hydrocarbon synthesis activity. In addition, proteins encoded by BAA14992 and BAA14869 were found to have significantly excellent hydrocarbon synthesis activity.

Example 2

In this Example, in vitro alkane synthesis was attempted using gene02 specified in Example 1 as a gene encoding a protein having excellent hydrocarbon synthesis activity.

Specifically, recombinant *Escherichia coli* prepared in Example 1, into which gene02 had been introduced, was cultured overnight in 1-ml LB medium (ampicillin: 100 μg/ml) at 37° C. and 100 rpm. Then, 1-ml LB medium (ampicillin 100 μg/ml, IPTG 0.5 mM) was inoculated with the obtained culture liquid to result in 1% culture liquid by volume, followed by culture at 30° C. and 120 rpm for 6 hours. Next, cells were harvested from the culture product (4° C., 6000×g, 3 minutes). The cells were suspended in 500 μl of phosphate buffer (pH 7.2), following which the cells were disrupted using an ultrasonic disintegrator (4° C., 10 minutes). Subsequently, the obtained disruption solution was centrifuged (4° C., 10000×g, 5 minutes) to collect the supernatant. The collected solution was subjected to enzymatic assay.

An enzymatic reaction was carried out overnight at 30° C. using the reaction composition shown in table 9. In addition, 8 types of $C_{11}$-$C_{18}$ aldehyde compounds were used in this Example. Here, alkane with a carbon number one less than that of an aldehyde compound is synthesized.

TABLE 9

| <Reaction solution composition> | |
|---|---|
| Phosphate buffer (pH 7.2): | 500 μl |
| Aldehyde: | Final concentration 1 mM |
| NADH: | Final concentration 1 mM |
| Disruption solution supernatant: | 500 μl |

Figure 4:
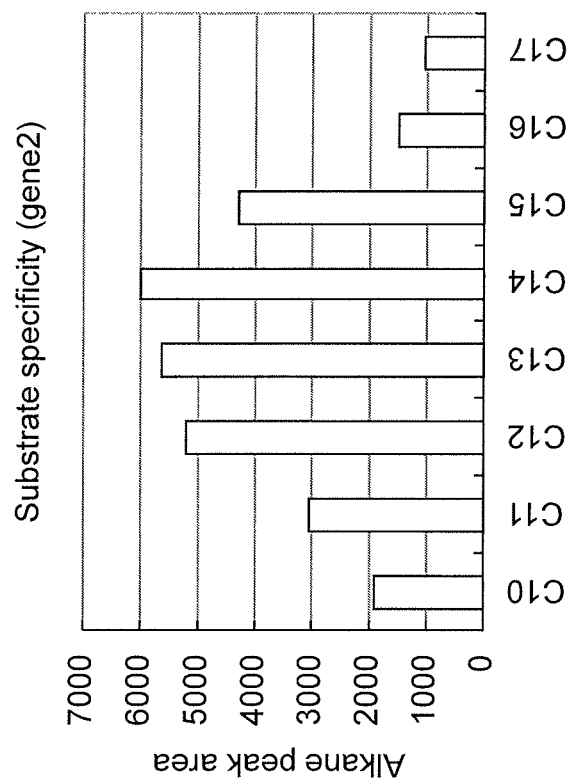
FIG. 4 is characteristic chart showing results of determining "activity of synthesizing a hydrocarbon with a carbon number one less than that of an aldehyde compound from the aldehyde compound" using different aldehyde compounds as substrates for disruption solution supernatants of transformants into which gene02 from *Klebsiella* sp. has been introduced.
Figure 5:
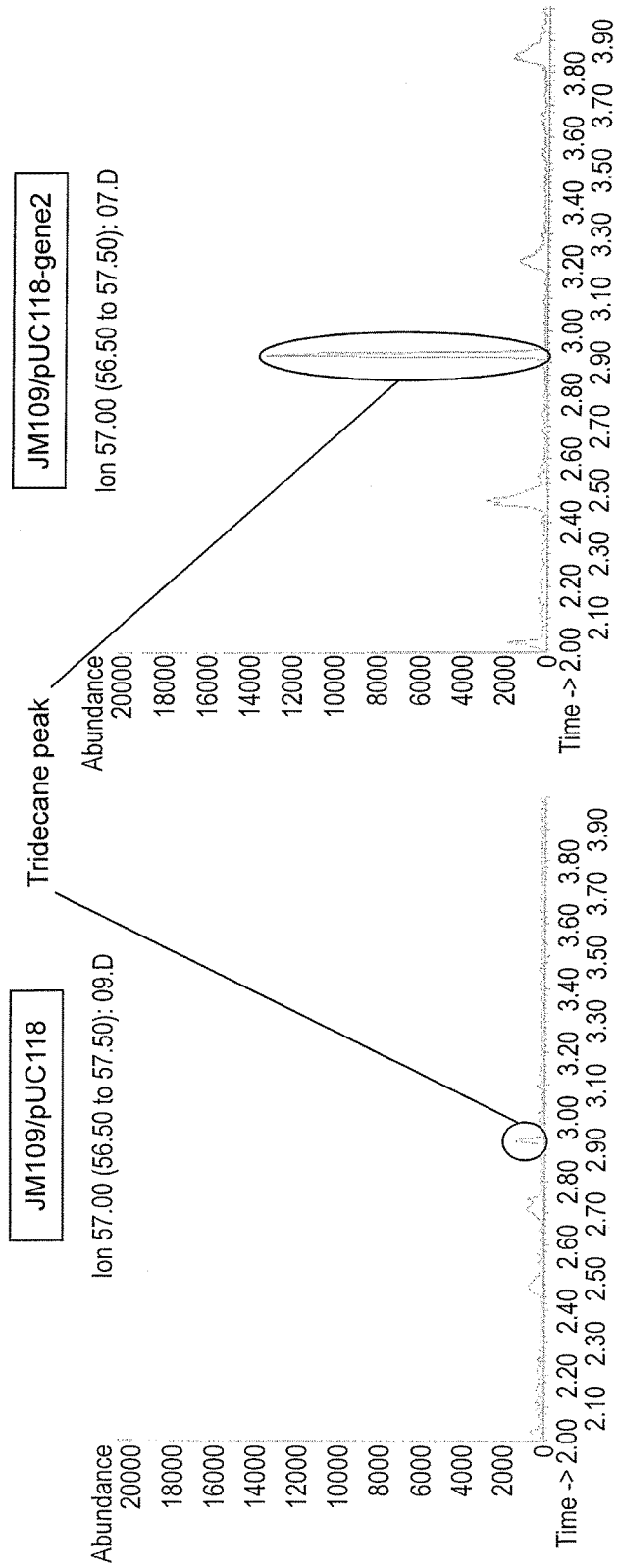
FIG. 5 shows a GC/MS analysis chart for a vector control strain and that for a strain into which gene02 has been introduced created by assaying $C_{13}$ alkane using a $C_{14}$ aldehyde compound as a substrate.

FIG. 4 shows the results of quantitative determination for synthesized $C_{10}$-$C_{17}$ alkanes. As is understood from FIG. 4, the protein encoded by gene02 was found to have excellent capacity to synthesize alkane, and in particular, $C_{12}$-$C_{14}$ alkane. FIG. 5 shows a GC/MS analysis chart for a vector control strain and that for a strain into which gene02 has been introduced created by assaying $C_{13}$ alkane using a $C_{14}$ aldehyde compound as a substrate.

Example 3

In this Example, in vitro alkane synthesis was attempted using the purified protein encoded by gene04 identified in Example 1.

Specifically, PCR was performed using, as a template, genome DNA of the *Klebsiella* sp. NBRC100048 strain prepared in the manner described in Example 1 and a pair of primers (forward primer: accacagccaggatccGCGTTATG-CACACCCTGGCCAGCCCGGCGCCCTG (SEQ ID NO: 63); reverse primer: gctcgaattcggatccTCAGAACAGGC-CCAGCGGCGCGGTGCCGTAGCT (SEQ ID NO: 64)). The PCR product was ligated to the BamHI site of pRSF-duet-1 plasmid (Novagen). A PCR amplification kit, a PCR product purification kit, and a PCR product ligation kit used herein were the same as those used in Example 1.

Next, *E. coli* BL21 (DE3) was transformed using the obtained expression vector. Transformed *Escherichia coli* was cultured overnight in 2-ml LB medium (kanamycin: 20 μg/ml) at 37° C. and 120 rpm. Then, 10-ml LB medium (kanamycin: 20 μg/ml, IPTG 0.5 mM) was inoculated with the obtained culture liquid to result in 1% culture liquid by volume, followed by culture at 37° C. for 5 hours. Cells were harvested from the culture product (4° C., 6000×g, 3 minutes). The cells were suspended in 1 ml of phosphate buffer (pH 7.2) and disrupted using an ultrasonic disintegrator (4° C., 10 minutes).

A His-tag protein was purified from the obtained disruption solution using TALON CellThru Resin (Clontech). FIG.

Figure 6:
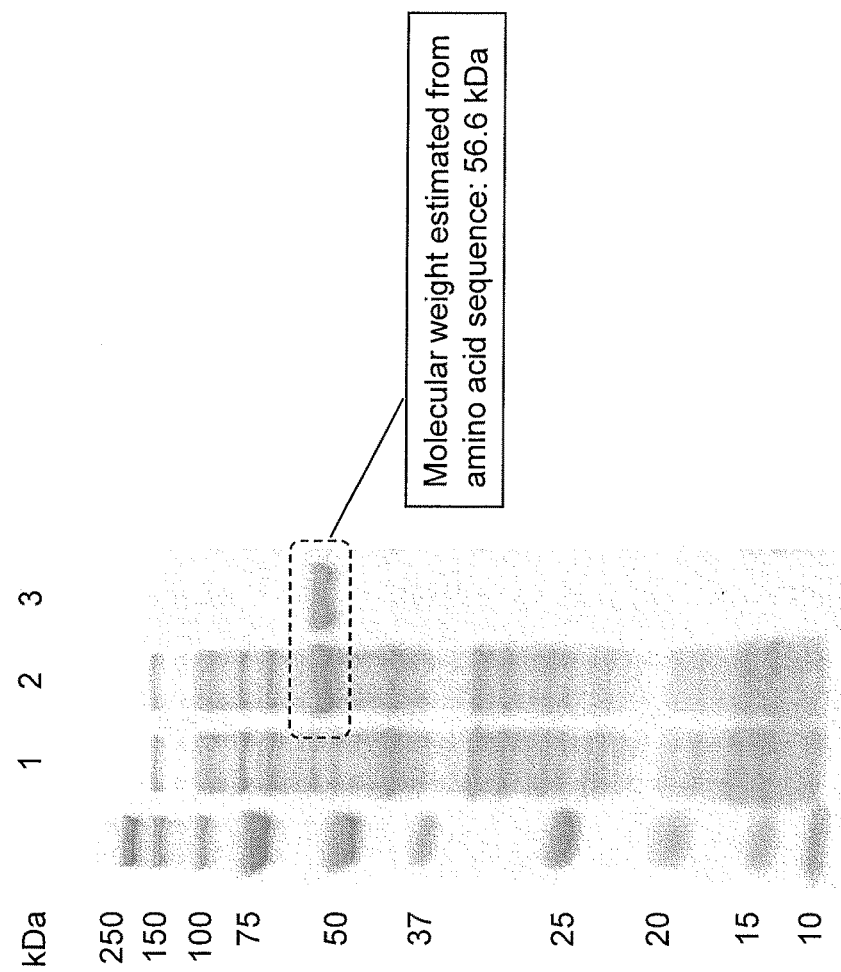
FIG. 6 shows an image indicating SDS-PAGE results for a disruption solution of transformed *Escherichia coli* and a purified His-tag protein solution.

6 shows SDS-PAGE results for a disruption solution of Escherichia coli transformed with pRSFduet-1 plasmid to which gene04 had been ligated, a disruption solution of Escherichia coli transformed with pRSFduet-1 plasmid to which gene04 had not been ligated, and a solution containing the purified His-tag protein. In FIG. 6, lane 1 represents the disruption solution of Escherichia coli transformed with pRSFduet-1 plasmid to which gene04 had not been ligated, lane 2 represents the disruption solution of Escherichia coli transformed with pRSFduet-1 plasmid to which gene04 had been ligated, and lane 3 represents the solution containing the purified His-tag protein. As shown in FIG. 6, it was revealed that the purified His-tag protein was observed at a position corresponding to a molecular weight of 56.6 kDa of a protein predicted from the nucleotide sequence of gene04.

An alkane synthesis reaction was carried out in vitro using the solution containing the His-tag protein. An enzymatic reaction was carried out overnight at 30° C. using the reaction composition shown in table 10. In addition, tetradecanal was used as an aldehyde compound in this Example. Here, tridecane is synthesized as an alkane.

TABLE 10

<Reaction solution composition>

| | |
|---|---|
| Phosphate buffer (pH 7.2): | 500 μl |
| Aldehyde: | Final concentration 1 mM |
| NADH: | Final concentration 1 mM |
| His-tag protein eluate: | 500 μl |

Figure 7:
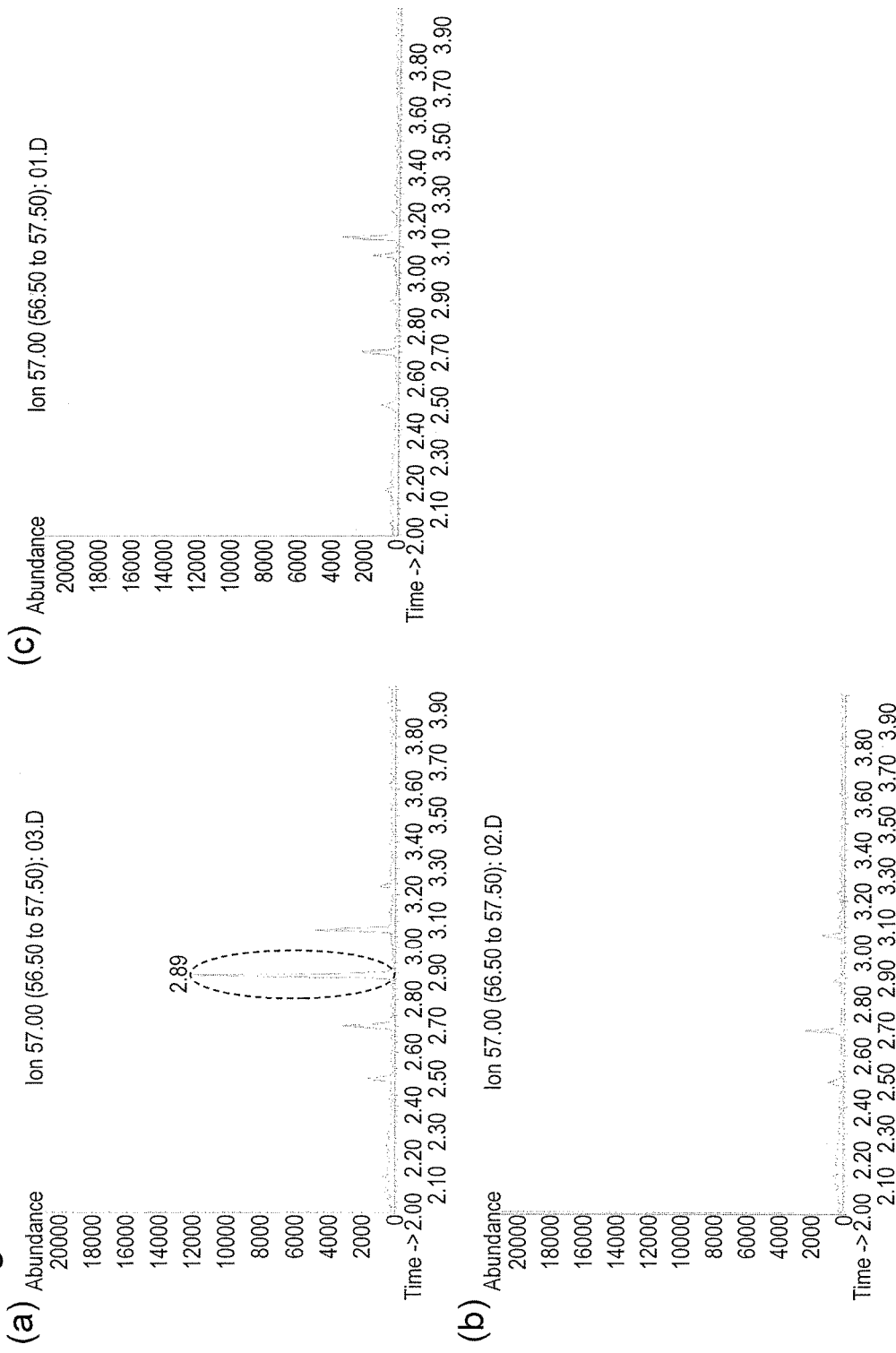
FIG. 7 shows GC/MS analysis charts indicating in vitro alkane synthesis results obtained using purified His-tag proteins.

After the termination of the enzymatic reaction, synthesized alkane was subjected to GC/MS analysis in the manner described in Example 1 or 2. FIG. 7 shows GC/MS analysis charts. In FIG. 7, chart (a) is an analysis chart for GC/MS analysis using the above reaction solution composition, chart (b) is an analysis chart for GC/MS analysis in which the His-tag protein eluate was not added to the reaction solution composition, and chart (c) is an analysis chart for GC/MS analysis in which no coenzyme was added to the reaction solution composition. As shown in FIG. 7, in this Example, it was revealed that a purified protein encoded by gene04 (but not a protein in cell extract) has hydrocarbon synthesis activity.

Figure 8:
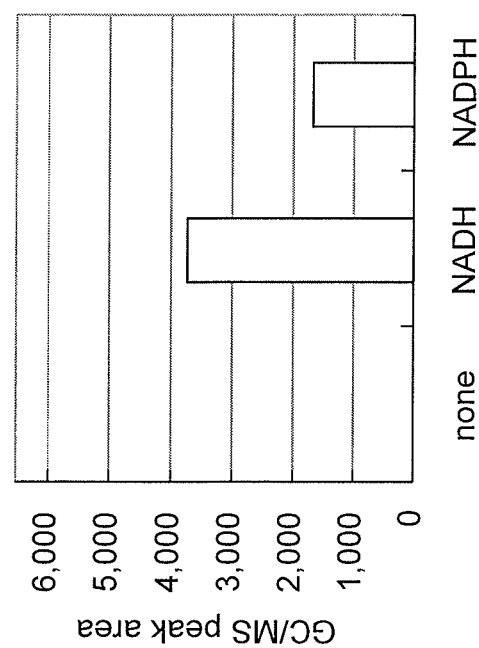
FIG. 8 is a characteristic chart showing results of a comparison of alkane synthesis capacity between NADH and NADPH used as coenzymes.

Further, hydrocarbon synthesis activity determined with the use of NADPH as a coenzyme was examined in this Example. Specifically, an enzymatic reaction was carried out in the manner described above except that NADPH was used as a coenzyme. A synthesized alkane was subjected to GC/MS analysis. FIG. 8 shows the results. As is understood from FIG. 8, it was found that both NADPH and NADH can be used as a coenzyme for a protein encoded by gene04. In addition, the protein encoded by gene04 was found to have superior hydrocarbon synthesis activity when NADH is used as a coenzyme compared with that obtained when NADPH is used.

Example 4

In this Example, alkane synthesis was attempted by allowing yeast to express gene02 specified in Example 1 as a gene encoding a protein having excellent hydrocarbon synthesis activity.

Specifically, PCR was performed using, as a template, genome DNA of the Klebsiella sp. NBRC100048 strain prepared in the manner described in Example 1 and a pair of primers (forward primer: aacaaacaaaggatccaaaaaaATGCGT-TATGCACACCCTGGCCAGC (SEQ ID NO: 171); reverse primer: gtcgtattacggatccttaTCAGAACAGGCCCAGCG-GCGCGGTG (SEQ ID NO: 172)). PfuUltra II Fusion HS DNA Polymerase (Stratagene) was used for PCR.

PCR-amplified nucleic acid fragments were ligated to the BamHI site of a pESCpgkgap-HIS vector (see WO2012/098662) using an In-Fusion HD Cloning Kit (Clontech). The Saccharomyces cerevisiae YPH499 strain was transformed using the obtained expression plasmid. Yeast was transformed in accordance with the protocol provided with a Frozen-EZ Yeast Transformation II Kit (ZYMO RESEARCH).

Next, 1-ml SD-His liquid medium was inoculated with colonies of the obtained yeast transformant, followed by overnight culture at 30° C. (Oriental Giken Inc.: IFM type, 130 rpm). Thereafter, 3-ml SD-His medium (supplemented with 1 mM tetradecanal) was inoculated with the obtained preculture liquid to result in 1% preculture liquid by volume, followed by culture at 30° C. and 100 rpm for 2 days.

Figure 9:
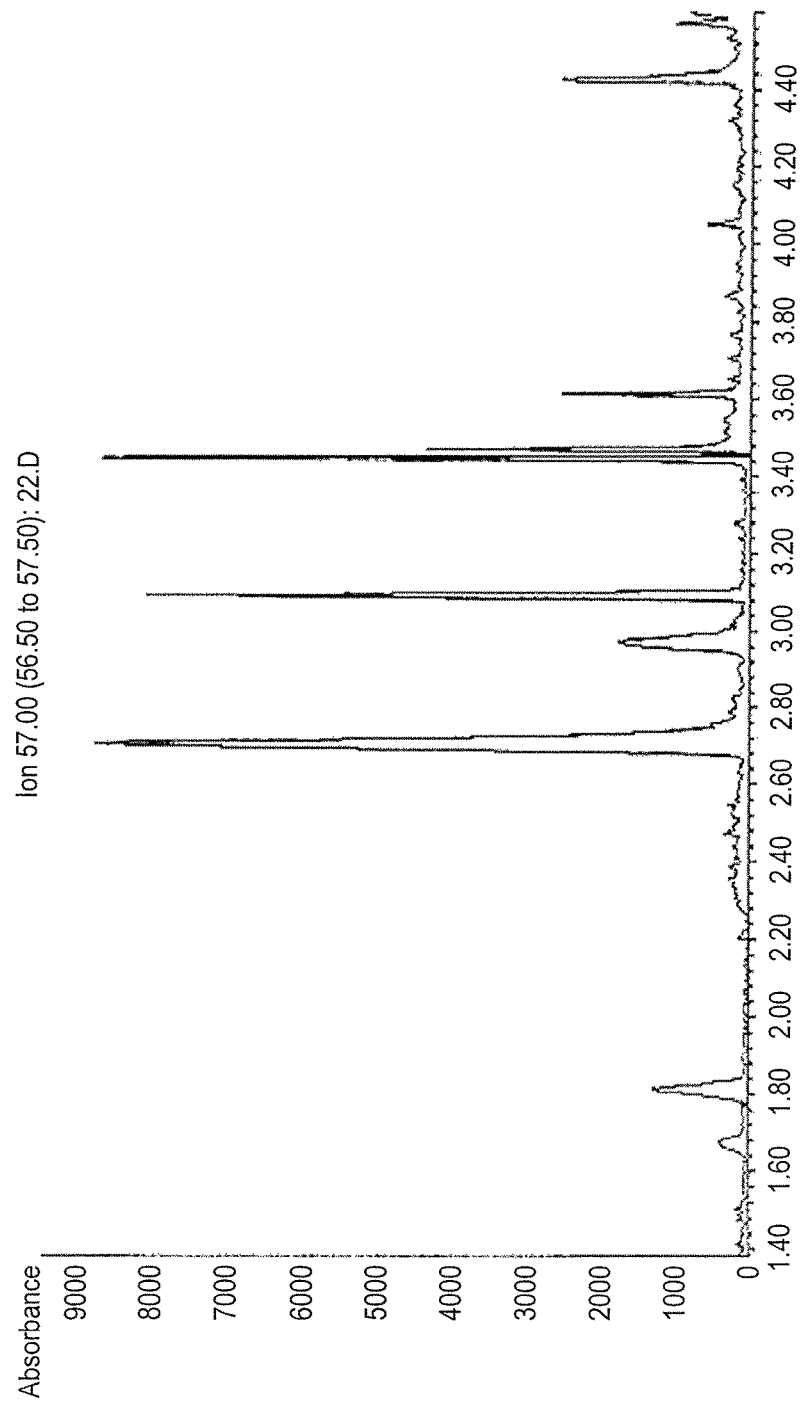
FIG. 9 shows a GC/MS analysis chart of yeast transformants into which gene02 has been introduced.

After the termination of culture, GC/MS analysis was performed in the manner described in Example 1. FIG. 9 shows the analysis results. As shown in FIG. 9, it was found that the Klebsiella sp. NBRC100048 strain-derived gene (gene02) functions as a gene encoding a protein having excellent hydrocarbon synthesis activity even if yeast is used as a host.

Example 5

In this Example, alkane synthase genes from a variety of organism species were evaluated for alkane synthesis capacity.

Specifically, the 53 types of genes (Corynebacterium glutamicum ATCC13032-derived genes, a Lactobacillus reuteri DSM20016-derived gene, Saccharomyces cerevisiae-derived genes, Candida tropicalis MYA-3404-derived genes, Debaryomyces hansenii CBS767-derived genes, Pichia pastoris GS115-derived genes, Schizosaccharomyces pombe-derived genes, Aspergillus oryzae RIB40-derived genes, a Zea mays-derived gene, Arabidopsis thaliana-derived genes, Drosophila melanogaster-derived genes, Rattus norvegicus-derived genes, and Homo sapiens-derived genes) listed in table 3 above were evaluated for alkane synthesis capacity in the manner described in Example 1. In addition, the Escherichia coli JM109 strain was used as a host in this Example.

The 53 types of genes were amplified using pairs of primers listed in table 11 below.

TABLE 11

| Test No. | Gene name | Forward primer | Sequence ID number | Reverse primer | Sequence ID number |
|---|---|---|---|---|---|
| 1 | NCgl0098 | cggtacccggggatccaaggagatataccATGACGTCGATGAATCTGCCTATTG | SEQ ID NO: 173 | cgactctagaggatccTCAACGTTTAAGTTCCTCCGCCAAC | SEQ ID NO: 174 |
| 2 | NCgl0463 | cggtacccggggatccaaggagatataccATGTCTTTGACCTTCCCAGTAATCA | SEQ ID NO: 175 | cgactctagaggatccTCACGGCAAAGCGAGGTAACGCACG | SEQ ID NO: 176 |

TABLE 11-continued

| Test No. | Gene name | Forward primer | Sequence ID number | Reverse primer | Sequence ID number |
|---|---|---|---|---|---|
| 3 | NCgl2698 | cggtacccggggatccaaggagatatacATGACTGTCTACGCAAATTCCAGGAA | SEQ ID NO: 177 | cgactctagaggatccTCAGAACAGTCCGGTTGGGTTTGGA | SEQ ID NO: 178 |
| 4 | NCgl0049 | cggtacccggggatccaaggagatataccATGACTATTAATGTCTCCGAACTAC | SEQ ID NO: 179 | cgactctagaggatccCTAGCCGGCGTAAGGATCCCGGATA | SEQ ID NO: 180 |
| 5 | NCgl2578 | cggtacccggggatccaaggagatataccATGACTGCAACATTTGCTGGAATCG | SEQ ID NO: 181 | cgactctagaggatccTTAGCTGCGCTTGATGCCGATCCAT | SEQ ID NO: 182 |
| 6 | NCgl2619 | cggtacccggggatccaaggagatataccATGATCAAACGTCTTCCTTTAGGTC | SEQ ID NO: 183 | cgactctagaggatccCTACGGCAAAACTTTAAAGATTTTG | SEQ ID NO: 184 |
| 7 | Lreu_0034 | cggtacccggggatccaaggagatataccATGGCATATCAAAGTATCAATCCAT | SEQ ID NO: 185 | cgactctagaggatccTTATTGTCGTGCTTCGTAAATTAGA | SEQ ID NO: 186 |
| 8 | YER073W | cggtacccggggatccGCTTTCTCGCACAAGAGCTGCAG | SEQ ID NO: 187 | cgactctagaggatccTTATCAACGAATTGGCTTGTCAATGGCA | SEQ ID NO: 188 |
| 9 | YHR037W | cggtacccggggatccGCTATCAGCAAGGTGCCTCAAAT | SEQ ID NO: 189 | cgactctagaggatccTTATTATTCATAATTCGATGGATATTTG | SEQ ID NO: 190 |
| 10 | YHR039C | cggtacccggggatccGTCCAAGGTCTATCTGAATTCAG | SEQ ID NO: 191 | cgactctagaggatccTTACTAGCTGGCTTCTTTAGCTAAAGAG | SEQ ID NO: 192 |
| 11 | YMR169C | cggtacccggggatccGCCTACCTTGTATACTGATATCG | SEQ ID NO: 193 | cgactctagaggatccTTATTATTTATCCAATGAAAGATCCACA | SEQ ID NO: 194 |
| 12 | YMR170C | cggtacccggggatccGCCTACCTTGTATACTGATATCG | SEQ ID NO: 195 | cgactctagaggatccTTATTAGTTGTCCAAAGAGAGATTTATG | SEQ ID NO: 196 |
| 13 | YOR374W | cggtacccggggatccGTTCAGTAGATCTACGCTCTGCT | SEQ ID NO: 197 | cgactctagaggatccTTACTCGTCCAATTTGGCACGGACC | SEQ ID NO: 198 |
| 14 | YBR006W | cggtacccggggatccGACTTTGAGTAAGTATTCTAAAC | SEQ ID NO: 199 | cgactctagaggatccTTATTAAATGCTGTTTGGCAAATTCCCA | SEQ ID NO: 200 |
| 15 | YMR110C | cggtacccggggatccGTCAAACGACGTGCCAAAAATAT | SEQ ID NO: 201 | cgactctagaggatccTTATCAGGAAGAACAATGAGCGTAAATG | SEQ ID NO: 202 |
| 16 | YPL061W | cggtacccggggatccGACTAAGCTACACTTTGACACTG | SEQ ID NO: 203 | cgactctagaggatccTTATTACAACTTAATTCTGACAGCTTTT | SEQ ID NO: 204 |
| 17 | CTRG_04587 | cggtacccggggatccaacaaacaaggatccaaaaaaATG | SEQ ID NO: 205 | cgactctagaggatcctagtgagtcgtattacggatcctta | SEQ ID NO: 206 |
| 18 | CTRG_01342 | cggtacccggggatccaacaaacaaggatccaaaaaaATG | SEQ ID NO: 205 | cgactctagaggatcctagtgagtcgtattacggatcctta | SEQ ID NO: 206 |
| 19 | CTRG_00532 | cggtacccggggatccaacaaacaaggatccaaaaaaATG | SEQ ID NO: 205 | cgactctagaggatcctagtgagtcgtattacggatcctta | SEQ ID NO: 206 |
| 20 | DEHA2G03740g | cggtacccggggatccaacaaacaaggatccaaaaaaATG | SEQ ID NO: 205 | cgactctagaggatcctagtgagtcgtattacggatcctta | SEQ ID NO: 206 |
| 21 | DEHA2G22572g | cggtacccggggatccaacaaacaaggatccaaaaaaATG | SEQ ID NO: 205 | cgactctagaggatcctagtgagtcgtattacggatcctta | SEQ ID NO: 206 |
| 22 | DEHA2B10384g | cggtacccggggatccaacaaacaaggatccaaaaaaATG | SEQ ID NO: 205 | cgactctagaggatcctagtgagtcgtattacggatcctta | SEQ ID NO: 206 |
| 23 | PAS_chr1-3_0024 | cggtacccggggatccaacaaacaaggatccaaaaaaATG | SEQ ID NO: 205 | cgactctagaggatcctagtgagtcgtattacggatcctta | SEQ ID NO: 206 |
| 24 | PAS_chr2-1_0853 | cggtacccggggatccaacaaacaaggatccaaaaaaATG | SEQ ID NO: 205 | cgactctagaggatcctagtgagtcgtattacggatcctta | SEQ ID NO: 206 |
| 25 | PAS_chr4_0043 | cggtacccggggatccaacaaacaaggatccaaaaaaATG | SEQ ID NO: 205 | cgactctagaggatcctagtgagtcgtattacggatcctta | SEQ ID NO: 206 |
| 26 | SPAC139.05 | cggtacccggggatccaacaaacaaggatccaaaaaaATG | SEQ ID NO: 205 | cgactctagaggatcctagtgagtcgtattacggatcctta | SEQ ID NO: 206 |
| 27 | SPAC1002.12c | cggtacccggggatccaacaaacaaggatccaaaaaaATG | SEQ ID NO: 205 | cgactctagaggatcctagtgagtcgtattacggatcctta | SEQ ID NO: 206 |

TABLE 11-continued

| Test No. | Gene name | Forward primer | Sequence ID number | Reverse primer | Sequence ID number |
|---|---|---|---|---|---|
| 28 | SPAC9E9.09c | cggtacccggggatccaacaaacaaag gatccaaaaaaATG | SEQ ID NO: 205 | cgactctagaggatcctagtgagt cgtattacggatccta | SEQ ID NO: 206 |
| 29 | AOR_1_1204144 | cggtacccggggatccaacaaacaaag gatccaaaaaaATG | SEQ ID NO: 205 | cgactctagaggatcctagtgagt cgtattacggatccta | SEQ ID NO: 206 |
| 30 | AOR_1_1330014 | cggtacccggggatccaacaaacaaag gatccaaaaaaATG | SEQ ID NO: 205 | cgactctagaggatcctagtgagt cgtattacggatccta | SEQ ID NO: 206 |
| 31 | 100284047 | cggtacccggggatccaacaaacaaag gatccaaaaaaATG | SEQ ID NO: 205 | cgactctagaggatcctagtgagt cgtattacggatccta | SEQ ID NO: 206 |
| 32 | AT1G23800 | cggtacccggggatccGGCATCAAGAA GAGTTTCTTCGC | SEQ ID NO: 207 | cgactctagaggatccTTATTAGA GCCAGGCAGGGTTCTTGAGG | SEQ ID NO: 208 |
| 33 | AT1G74920 | cggtacccggggatccGGCGATTCCGA TGCCTACTCGCC | SEQ ID NO: 209 | cgactctagaggatccTTATTAGT TGGGAGATTTGTACCATCCC | SEQ ID NO: 210 |
| 34 | ATIG79440 | cggtacccggggatccGGTAATAGGAG CAGCAGCGCGTG | SEQ ID NO: 211 | cgactctagaggatccTTATCAGT GTCTATTCATATCTCCCAAG | SEQ ID NO: 212 |
| 35 | AT2G24270 | cggtacccggggatccGGCCGGGACTG GATTGTTTGCTG | SEQ ID NO: 213 | cgactctagaggatccTTACTAAC CCATAGAGTAAGAAGGTGTA | SEQ ID NO: 214 |
| 36 | AT3G24503 | cggtacccggggatccGGAGAACGGCA AATGCAACGGAG | SEQ ID NO: 215 | cgactctagaggatccTTATTACA TCCAAGGGGAATTGTGAAGA | SEQ ID NO: 216 |
| 37 | AT3G48000 | cggtacccggggatccGGCGGCTCGTA GAGTGTCTTCTC | SEQ ID NO: 217 | cgactctagaggatccTTATCAGA TCCAGGCAGGCTTATTTGA | SEQ ID NO: 218 |
| 38 | AT1G54100 | cggtacccggggatccGGGTTCGGCGA ACAACGAGTACG | SEQ ID NO: 219 | cgactctagaggatccTTACTAAC CGAAGTTAATTCCTTGCGCT | SEQ ID NO: 220 |
| 39 | Dmel_CG3752 | cggtacccggggatccGCTGCGCGTTT TGAAGACCGGTG | SEQ ID NO: 221 | cgactctagaggatccTTATTAGG AGTTCTTCTGGGCAACCTTG | SEQ ID NO: 222 |
| 40 | Dmel_CG7145 | cggtacccggggatccGTTGCGAATGA TGCGAAGTTCCT | SEQ ID NO: 223 | cgactctagaggatccTTATTACT CGCACATGTATGGATAGTTG | SEQ ID NO: 224 |
| 41 | Dmel_CG8665 | cggtacccggggatccGGCTCTAAAAA TGAGAATCGCAA | SEQ ID NO: 225 | cgactctagaggatccTTACTAAT ATTCAACTGTGACACACTTG | SEQ ID NO: 226 |
| 42 | Dmel_CG11140 | cggtacccggggatccGTTTGACAACG CGATTAAACCTC | SEQ ID NO: 227 | cgactctagaggatccTTATCACG TCCACCAAGATGGTGGGTTC | SEQ ID NO: 228 |
| 43 | Dmel_CG31075 | cggtacccggggatccGGCCGATCCCA ACGCCAGCCCA | SEQ ID NO: 229 | cgactctagaggatccTTATTAAA GAAGTTTCATGGTGATGGTC | SEQ ID NO: 230 |
| 44 | Dmel_CG4685 | cggtacccggggatccGTGGCGACAGC TCAGCGGAGTCG | SEQ ID NO: 231 | cgactctagaggatccTTATCAGT CGTACTTGAGGTTGCCCATG | SEQ ID NO: 232 |
| 45 | Dmel_CG9629 | cggtacccggggatccGTTGGCACAAT TGAGAAATATTT | SEQ ID NO: 233 | cgactctagaggatccTTACTACT CCACATTGAAGACAACACCC | SEQ ID NO: 234 |
| 46 | 24188 | cggtacccggggatccGTCTTCCCCTG CACAGCCTGCAG | SEQ ID NO: 235 | cgactctagaggatccTTATTAGG AGTTCTTCTGAGATATTTTC | SEQ ID NO: 236 |
| 47 | 641316 | cggtacccggggatccGCTGCCGCCGG CTTTGCTTCGCC | SEQ ID NO: 237 | cgactctagaggatccTTATTACT GCATGTAGGAGTATCGCCAG | SEQ ID NO: 238 |
| 48 | 216 | cggtacccggggatccGTCATCCTCAG GCACGCCAGACT | SEQ ID NO: 239 | cgactctagaggatccTTATTATG AGTTCTTCTGAGAGATTTTC | SEQ ID NO: 240 |
| 49 | 219 | cggtacccggggatccGCTGCGCTTCC TGGCACCCCGGC | SEQ ID NO: 241 | cgactctagaggatccTTATTACG AGTTCTTCTGAGGAACCTTG | SEQ ID NO: 242 |
| 50 | 223 | cggtacccggggatccGTTTCTCCGAG CAGGCCTGGCCG | SEQ ID NO: 243 | cgactctagaggatccTTATCAAA AAGCAGATTCCACATCACCC | SEQ ID NO: 244 |
| 51 | 224 | cggtacccggggatccGGAGCTCGAAG TCCGGCGGGTCCC | SEQ ID NO: 245 | cgactctagaggatccTTATCAGT AATATTCTGCCTTGACAAGC | SEQ ID NO: 246 |
| 52 | 501 | cggtacccggggatccGTGGCGCCTTC CTCGCGCGCTGT | SEQ ID NO: 247 | cgactctagaggatccTTATTACT GAAACTTGATTCCTTGGGCC | SEQ ID NO: 248 |

TABLE 11-continued

| Test No. | Gene name | Forward primer | Sequence ID number | Reverse primer | Sequence ID number |
|---|---|---|---|---|---|
| 53 | 64577 | cggtacccggggatccGGCTGGAACAAACGCACTTTTGA | SEQ ID NO: 249 | cgactctagaggatccTTATCAGTGTTTAACGGTGATGGTTTTG | SEQ ID NO: 250 |

Among the 53 types of genes listed in table 11, genome DNAs extracted from the corresponding strains were used as templates for the *Corynebacterium glutamicum* ATCC13032-derived genes (NCgl0098, NCgl0463, NCgl2698, NCgl0049, NCgl2578, and NCgl2619), the *Lactobacillus reuteri* DSM20016-derived gene (Lreu_0034), and the *Saccharomyces cerevisiae*-derived genes (YER073W, YHR037W, YHR039C, YMR169C, YMR170C, YOR374W, YBR006W, YMR110C, and YPL061W). In addition, among the 53 types of genes listed in table 11, artificial genes chemically synthesized based on the amino acid sequences in the KEGG database were used as templates for the *Candida tropicalis* MYA-3404-derived genes (CTRG_04587, CTRG_01342, and CTRG_00532), the *Debaryomyces hansenii* CBS767-derived genes (DEHA2G03740g, DEHA2G22572g, and DEHA2B10384g), the *Pichia pastoris* GS115-derived genes (PAS_chr1-3_0024, PAS_chr2-1_0853, and PAS_chr4_0043), the *Schizosaccharomyces pombe*-derived genes (SPAC139.05, SPAC1002.12c and SPAC9E9.09c), the *Aspergillus oryzae* RIB40-derived genes (AOR_1_1204144 and AOR_1_1330014), and the *Zea mays*-derived gene (100284047). Further, among the 53 types of genes listed in table 11, a cDNA library (ATCC77500) purchased from the ATCC (American Type Culture Collection) was used as a template for the *Arabidopsis thaliana*-derived genes (AT1G23800, AT1G74920, AT1G79440, AT2G24270, AT3G24503, AT3G48000, and AT1G54100). Furthermore, among the 53 types of genes listed in table 11, a cDNA library (ATCC87285) purchased from the ATCC (American Type Culture Collection) was used as a template for the *Drosophila melanogaster*-derived genes (Dmel_CG3752, Dmel_CG7145, Dmel_CG8665, Dmel_CG11140, Dmel_CG31075, Dmel_CG4685, and Dmel_CG9629). Moreover, among the 53 types of genes listed in table 11, a cDNA library (ATCC77403) purchased from the ATCC (American Type Culture Collection) was used as a template for the *Rattus norvegicus*-derived genes (24188 and 641316). Also, among the 53 types of genes listed in table 11, a cDNA library (ATCC77402) purchased from the ATCC (American Type Culture Collection) was used as a template for the *Homo sapiens*-derived genes (216, 219, 223, 224, 501, and 64577).

Here, the PCR conditions, the conditions for culturing transformants, and the alkane analysis method are the same as those described in Example 1. FIGS. 10-1 and 10-2 show the alkane analysis results. As shown in FIGS. 10-1 and 10-2, it was revealed that all the 53 types of genes described above have hydrocarbon synthesis activity. In particular, the following genes were found to have remarkably excellent hydrocarbon synthesis activity: NCgl0098 (Test No. 1), NCgl0049 (Test No. 4), NCgl2619 (Test No. 6), YER073W (Test No. 8), YOR374W (Test No. 13), YBR006W (Test No. 14), YMR110C (Test No. 15), CTRG_04587 (Test No. 17), PAS_chr2-1_0853 (Test No. 24), SPAC139.05 (Test No. 26), AOR_1_1204144 (Test No. 29), and Dmel_CG7145 (Test No. 40).

All publications, patents, and patent applications cited herein are incorporated by reference in their entirety.

SEQUENCE LISTING (250 sequences)

SEQ ID NO: 1 - protein, 8 aa, Artificial Sequence
  Aldehyde dehydrogenases glutamic acid active site
  misc_feature (1)..(1): Xaa is Leu, Ile, Val, Met, Phe, Gly, or Ala
  misc_feature (3)..(3): Xaa is Leu, Ile, Met, Ser, Thr, Ala, or Cys
  misc_feature (4)..(4): Xaa is Gly or Ser
  misc_feature (6)..(6): Xaa is Lys, Asn, Leu, or Met
  misc_feature (7)..(7): Xaa is Ser, Ala, Asp, or Asn
  misc_feature (8)..(8): Xaa is Thr, Ala, Pro, Phe, or Val
XEXXGXXX

SEQ ID NO: 2 - protein, 13 aa, Artificial Sequence
  Consensus sequence
  misc_feature (1)..(1): Xaa is Pro, Ala, or Phe
  misc_feature (2)..(2): Xaa is Phe, His, or Val
  misc_feature (3)..(3): Xaa is Gly or Ala
  misc_feature (5)..(5): Xaa can be any naturally occurring amino acid
  misc_feature (6)..(6): Xaa is Lys, Gly, or Arg
  misc_feature (7)..(7): Xaa can be any naturally occurring amino acid
  misc_feature (10)..(10): Xaa can be any naturally occurring amino acid
  misc_feature (11)..(11): Xaa is Gly or His
  misc_feature (12)..(12): Xaa is Arg, Gly, or Lys
  misc_feature (13)..(13): Xaa is Glu, Asp, Pro, or Ala
XXXGXXXSGXXXX

SEQ ID NO: 3 - DNA, 1485 bp, Klebsiella sp.
  CDS (1)..(1485)
atgagcgagataaccttactggcggaagtgaccgcctttttacgccagccgcacgggcagtttatcgccggtgagcgagaggcgggccgcggcgcgccgtttgcggtgatcaacccggccaccgggcgggcgatcgccgaggtcaccgcggcggatagcgaccaggcggatcgcgcggtagagagtgcccgccaggcgtttaatcagtggcgcgaaatgccgacgctggcgcgcggaaccttgctgctgaagctggcggatgccctggctgagcatcgcgaagcgctggcgcagctggaaagtctctgctccggcaagaccatcacgctggcgcgcatgctcgagctggatcagtcggtcgctttcctgcgctacttcgccggctgggcggggaaagtcaccggcgaaaccctgaatgtgtcgctgccgtcgatggccggggagaaatataccgccttcactcgccgtcagccgctgggggtagtggtgggcatcgtgccgtggaacttctccatcatgattgccgtctggaagctggcggcggccctggtctgcggctgcaccattgttctcaagccgagcgagtatacgccgctgacgctgctgcgcgtggcggagctggcaaaagcggtgggtattccggacggggtgattaacgtggtcaacggcgccggcggcgagattgctcagcggctgattacccacccggcctgcgccaaggtgagcttcaccggctcggtggccactggcgagaaagtccagcagtcggccagtgcgtcaggtaaacgggtgacccttgagctggggggcaaaaacgccgcgctgttcctggatgatctgacgccggaggcgatggtcaacggcattctggaagccggctacctgaatcaggggcagatttgcgccgccgcggagcgcttttatctgccgcagggtaaactggatgcggtgctggcgctgctgaaagataagctcagcgccttcgcgccgggatcgccgctggatgagcgcacgctgatggggccgctggccaaccgccagcagtatgacaaagtgttgcggctcattcagaccgcgcgcgacgagggcgataccatcgtctgcggcggcgaagccctgccgggggagggctatttcctgcagccgacggcggtcaaagtgcgcagcgaagagagcaccctgatgcgcgaggagaccttcggcccggtgtgcagttttatcggttatcacagtgaagacgaggcgctggcgcggatcaatgcctcgccgtatggcctggcggccagcgtctggtcggataatattcgcctggcgctgcgctactcggaggcgattgaggccggcatcgtgtgggtcaatatgcataccttcctcgacccggcggtaccgttcggcggcatgaagggctcgggcatcgggcgcgaattcggcagcgcgtttatcgatgactacacggagctgaagtcggtgatggtgcgatattaa

SEQ ID NO: 4 - protein, 494 aa, Klebsiella sp.
MSEITLLAEVTAFLRQPHGQFIAGEREAGRGAPFAVINPATGRAIAEVTAADSDQADRAVESARQAFNQWREMPTLARGTLLLKLADALAEHREALAQLESLCSGKTITLARMLELDQSVAFLRYFAGWAGKVTGETLNVSLPSMAGEKYTAFTRRQPLGVVVGIVPWNFSIMIAVWKLAAALVCGCTIVLKPSEYTPLTLLRVAELAKAVGIPDGVINVVNGAGGEIAQRLITHPACAKVSFTGSVATGEKVQQSASASGKRVTLELGGKNAALFLDDLTPEAMVNGILEAGYLNQGQICAAAERFYLPQGKLDAVLALLKDKLSAFAPGSPLDERTLMGPLANRQQYDKVLRLIQTARDEGDTIVCGGEALPGEGYFLQPTAVKVRSEESTLMREETFGPVCSFIGYHSEDEALARINASPYGLAASVWSDNIRLALRYSEAIEAGIVWVNMHTFLDPAVPFGGMKGSGIGREFGSAFIDDYTELKSVMVRY

SEQ ID NO: 5 - DNA, 1500 bp, Klebsiella sp.
  CDS (1)..(1500)
atgtccacctctcagatagcgctgcttgccagcgtccagcagtttttagaccgtcagcatggcctgtatatcgacggcgccccctgcgccgcgcagagcgaaaaccggttaaccgtctgggatccggccaccgggcaggcgatcgccaccaccgccgacgccagcccggcggatgttgaccgggcggtgatgtctgcctggcgtgccttcgtcgaccgccgctgggccgggcgcaccccggccgaccgcgagcgcatcctgctgcgctttgccgatctggtggagcagcacggcgaggagctggcgcagctggaaacccttgaacagggtaaatccatcgccatctcccgcgccttcgaggtcggttgcaccctgaactggatgcgctacaccgccgggctgaccaccaaaatcagcggccggacgctggacgtctcgatcccgttcccgcaaggggcgcgttatcaggcgtggaccaaaaaagagccggtgggggtagtggcgggcatcgttccgtggaatttcccgctgatgatcggtatgtggaaggtgatgccggcgctggcggcgggttgttcgatcgtcataaaaccctcagaaaccaccccgctgaccctgctgcgggtggcggagctggcgacccaggcgggcattcctgacggggtgttcaacgtggtcaccggcagcggcgccggctgcggcgcggcgctgaccgcccatccgcaggtggcgaaggtgagctttaccggctcgacggccaccgggaaacagattgcgcgggtggccgccgaccgcctgacccgcgtgacgctggagctgggcggcaagaacccggcgattgtgcttaaagacgccgatccccagtgggtcattgaggggctgatgaccggcagcttccttaaccaggggcaggtctgcgccgccagctcgcggatctacattgaagcgccgctgtttgacaccctggtcagcggcttcgagcaggcggtgaaatcactgcaggtagggccgggaatgctggagacggcgcagatcaacccggtggtctcccgggcccactgcgacaaggtggcggcctaccttgaagaggcccgacagcagaaggcggagcttatcagcggcagcgccggaccggatgcgggggggtactatattccgccgacgctggtggttaacccggacgccggactgcgcctcacccgcgaggaggtgtttggcccggtggtgaacctggtgcgggtggccgacggcgaggaggcgctgcgcctggccaatgacagcgattttggcctgaccgccagcgtctggacccgcgacctgacccaggctctcaactataccgagcgcctgcaggccgggacggtatgggtcaacagtcataccctgattgacgccaacctgccgttcggcggcatgaagcagtccggcaccggtcgcgatttcggcccggactggctcgacggctggtgcgaaaccaaatccgtctgcgtgcgttactag

SEQ ID NO: 6 - protein, 499 aa, Klebsiella sp.
MSTSQIALLASVQQFLDRQHGLYIDGAPCAAQSENRLTVWDPATGQAIATTADASPADVDRAVMSAWRAFVDRRWAGRTPADRERILLRFADLVEQHGEELAQLETLEQGKSIAISRAFEVGCTLNWMRYTAGLTTKISGRTLDVSIPFPQGARYQAWTKKEPVGVVAGIVPWNFPLMIGMWKVMPALAAGCSIVIKPSETTPLTLLRVAELATQAGIPDGVFNVVTGSGAGCGAALTAHPQVAKVSFTGSTATGKQIARVAADRLTRVTLELGGKNPAIVLKDADPQWVIEGLMTGSFLNQGQVCAASSRIYIEAPLFDTLVSGFEQAVKSLQVGPGMLETAQINPVVSRAHCDKVAAYLEEARQQKAELISGSAGPDAGGYYIPPTLVVNPDAGLRLTREEVFGPVVNLVRVADGEEALRLANDSDFGLTASVWTRDLTQALNYTERLQAGTVWVNSHTLIDANLPFGGMKQSGTGRDFGPDWLDGWCETKSVCVRY

SEQ ID NO: 7 - DNA, 1446 bp, Klebsiella sp.
  CDS (1)..(1446)
atgaaacaggataatgctatgcaacacaacctcttaataaacggtaagttagtggcaggtgaaggcgaaaaggtgccggtatacaaccctgcgaccggcgaagtgatcctggagattgccgaagcgacagcggcccaggtggatgccgccgttgaggcggcggatcgggcgtttgatgcctggagccagacgacgccgaaaacgcgcgcggaatgtctgctgaagctggcggatgccatcgcggcgcaggcggagcccctggcgcagctggagtcgctgaactgcggcaagccgctgcactgcgtgcttaacgatgagatgccggccattgcggacgttttccgcttcttcgccggcgccgcccgttgcctgccggggatggcggccggagagtatctggaagggcatacctcgatgatccgtcgcgatccggtgggcgtggtagcctccatcgcgccgtggaactatcccctgatgatggcggcctggaagctggccccggcgctggcggcaggcaactgtgtggtgataaaaccctccgagatcacgccgctgacggcgctgaagctggcagagctggcaaaagatattttcccggaaggggtgatcaacgtactgttcggccgcggcaaaacggtgggcgatccgctgaccgcccacgcgaaagtgcggatggtttccctgaccgggtcgattgccaccggcgcccatatcatcggccataccgcctcgtcgattaaacgtacccatatggagctgggcggtaaggcgccggtcatcgtctttgacgacgcggatatcgacgcggtagtggatggcgttcggactttcgggttttacaacgccggccaggactgtacggccgcctgccggatctacgcccaacagggtatttatgagcagctggtggagaagctcggggcggcggtggccagcctgaaaatgggagcgccggaggatgccgccaccgagctgggaccgctgagctcgctggcccatcttgagcgggtcagcgccgcggtggaagccgcaaaggcgctaccgcatattaaagtggttaccggtggcaatcgggctgacggcgccggctattatttccagccgacgctgctcgccggcgcccggcaggaggacgctatcgtgcagcgcgaagtgtttggcccggtggtcagcgtgacgcctttcagcgatgaagcgcaggccctgagctgggcaaatgactcccagtatgggctggcctcttcggtgtggacgaaagatgttggccgcgcccaccggctcagcgccaggctgcagtacggctgcacctgggtcaacacccactttatgctggtgagtgaaatgccgcatggcggccagaagctgtcgggctacgggaaagacatgtcgatgtatggccttgaggattacaccgtggttcgccatgtgatggttaaacatggctaa

SEQ ID NO: 8 - protein, 481 aa, Klebsiella sp.
MKQDNAMQHNLLINGKLVAGEGEKVPVYNPATGEVILEIAEATAAQVDAAVEAADRAFDAWSQTTPKTRAECLLKLADAIAAQAEPLAQLESLNCGKPLHCVLNDEMPAIADVFRFFAGAARCLPGMAAGEYLEGHTSMIRRDPVGVVASIAPWNYPLMMAAWKLAPALAAGNCVVIKPSEITPLTALKLAELAKDIFPEGVINVLFGRGKTVGDPLTAHAKVRMVSLTGSIATGAHIIGHTASSIKRTHMELGGKAPVIVFDDADIDAVVDGVRTFGFYNAGQDCTAACRIYAQQGIYEQLVEKLGAAVASLKMGAPEDAATELGPLSSLAHLERVSAAVEAAKALPHIKVVTGGNRADGAGYYFQPTLLAGARQEDAIVQREVFGPVVSVTPFSDEAQALSWANDSQYGLASSVWTKDVGRAHRLSARLQYGCTWVNTHFMLVSEMPHGGQKLSGYGKDMSMYGLEDYTVVRHVMVKHG

SEQ ID NO: 9 - DNA, 1521 bp, Klebsiella sp.
  CDS (1)..(1521)
atgcgttatgcacaccctggccagcccggcgccctggtttcatttaaatccgcttacggcaactttattgacggtaaatttgtcgagccgctgagcggtgaattctttatgaatacctccccggtagacggcagcaacattgcgcagtttccccggtcggatgccagagacattgacttcgccctcgacgccgcccaccgtgcggcgccggcgtggggcaaaacctcagtgcagcagcgctcccggctgctgctgcaggtcgccgatcgtattgaacagcatctggaatatctggcggtggcggagagctgggacaacgggaaaccgatccgcgaaacgctgaacgccgacctgccgctggcggtggatcattttcgctacttcgccggctgcctgcgcgcccaggaggggagtaccgccgagattgatgaaaccacggtggcttaccatttccatgaaccgctgggggttgtcggtcagattatcccgtggaacttcccgctgctgatggccgcgtggaagctggccccggccctggcggcgggtaactgcgtggtgctcaagccggcggaacagacgccgctgagtattactctgctgctggagctgatcggcgatctgttcccggccggggtgctgaacgtggtgcagggtttcggcaaagaggcgggcgaggcgctggccaccagcaaacgtatcgccaagctggcatttactggctccacgccggtcgggcggcatattctcgcctgcgcggcggagaatattatcccctgcaccgtcgagctggggggcaaatcgcccaatatctacttcgccgatgtgatggagggagaagaggagtttattgagaaggcggtggaggggctggtgctcggcttcttcaaccagggtgaggtttgtacctgcccgtcgcgggcgctgatccatgaatccatctatgagccctttatggcgcgggtcatggagaaggtggcgcagatccgccgcggcgatccgttagataccgacaccatgatcggcgcccaggcttcccgccagcagttcgacaagatcctctcctatattcagattgcccgggaagagggcggccaaatcctgacaggcggcgagcgggcggctatcgcgccggcgctggataatggtttttatattcagcccacgctaattaaaggccgcaacgatatgcgctccttccaggaggagatctttgggccggtgatcggggtgaccacctttaaggacgaagcggaagcgctggctatcgccaatgagacccagtttggcctcggcgctggggtgtggacgcgcgatactaacctcgcctatcgcatgggccgcggcataaaagcgggtcgcgtatggaccaactgctatcatgtctatccggcgcatgcggcgttcggcggctataaacagtccggcgtcggccgggaaacgcacaagatggcgctggatgcctaccagcaaaccaaaaacctgctggtgagctacggcaccgcgccgctgggcctgttctga

SEQ ID NO: 10 - protein, 506 aa, Klebsiella sp.
MRYAHPGQPGALVSFKSAYGNFIDGKFVEPLSGEFFMNTSPVDGSNIAQFPRSDARDIDFALDAAHRAAPAWGKTSVQQRSRLLLQVADRIEQHLEYLAVAESWDNGKPIRETLNADLPLAVDHFRYFAGCLRAQEGSTAEIDETTVAYHFHEPLGVVGQIIPWNFPLLMAAWKLAPALAAGNCVVLKPAEQTPLSITLLLELIGDLFPAGVLNVVQGFGKEAGEALATSKRIAKLAFTGSTPVGRHILACAAENIIPCTVELGGKSPNIYFADVMEGEEEFIEKAVEGLVLGFFNQGEVCTCPSRALIHESIYEPFMARVMEKVAQIRRGDPLDTDTMIGAQASRQQFDKILSYIQIAREEGGQILTGGERAAIAPALDNGFYIQPTLIKGRNDMRSFQEEIFGPVIGVTTFKDEAEALAIANETQFGLGAGVWTRDTNLAYRMGRGIKAGRVWTNCYHVYPAHAAFGGYKQSGVGRETHKMALDAYQQTKNLLVSYGTAPLGLF

SEQ ID NO: 11 - DNA, 1371 bp, Klebsiella sp.
  CDS (1)..(1371)
atggcctatcagacggtgaatcctgcgaacaatcagcttattaaaacgtacccggcgcacagcgatgcggacgtggaggcggcgctgcagcaggcggatgcgctctaccattcagcctgggcgaaaggggatatcgaaccgcgcctggcggtgctgcataagctggcggatctgatcgacagccgggtggaagatctggcgaaaatcgccagccaggagatggggaaactcattaagcagagccgcggcgaagtgaaactgtgcgcgcaaatcgcccgctattacgccgataacgccaaatcgatgctggcgccggtgaagtatccctccgaactgggtgaagcctgggttgagcaccaccccattggcgtcttactggcggtggagccgtggaacttcccctattaccagctgatgcgcgtcctggcgccaaacctggcggccgggaacccggttatcgccaaacacgccagcatcgtgccgcactgcgcggagacctttgctcatctggtgcgcgaggccggcgcaccggaaggggcgtggaccaatctgtttatctctcaggatcaggtggcgaagattatcgccgacgaccgtgtgcagggggcggcgctgaccgggtcagaaaaagccggcagcgtggtggcggcgcaggcggcgaagcatattaagaaatcgaccctggaactcggcggcaacgatgtgtttgtggtgctcgatgatgctgagctcgagcgcgcggtgaaaatcggcgtccaggcgcggctgaataacgccggccaggtgtgtactgccgccaagcggtttattctgcatgagaacatcgctgagtcgtttctgacgaaatttagcgaggcgtttcgccaggtaaaaataggcgatccgctggatgaaagcaccacgctggggccgctctcctctaaagatgcgctggaaaccttgagcaagcaggtggacgaggcggtcaaaaacggcgccacgctgcatctgggcggcaaagcggtggcgcgggaaggcaacttctttgaacccactatcctgaccggtatcacccgtgacaacccggcgtacttcgaagagttctttggcccggtggcgcagatctacgtggtgaaaaacgatgaggaggcgattgcgcttgccaatgattctcactatggcctgggcggcgcggtgttcagtcaggacatcgaacgcgccaaacggatggcatccgccattgaaaccgggatggtctatatcaactggctgaccgataccgcgcccgaactgccgtttggcggcgtgaagcgttccggttatggccgggagctctccgatctcgggatcaaagagttcgtgaaccagaagctggtggtggtgcgccgctag

SEQ ID NO: 12 - protein, 456 aa, Klebsiella sp.
MAYQTVNPANNQLIKTYPAHSDADVEAALQQADALYHSAWAKGDIEPRLAVLHKLADLIDSRVEDLAKIASQEMGKLIKQSRGEVKLCAQIARYYADNAKSMLAPVKYPSELGEAWVEHHPIGVLLAVEPWNFPYYQLMRVLAPNLAAGNPVIAKHASIVPHCAETFAHLVREAGAPEGAWTNLFISQDQVAKIIADDRVQGAALTGSEKAGSVVAAQAAKHIKKSTLELGGNDVFVVLDDAELERAVKIGVQARLNNAGQVCTAAKRFILHENIAESFLTKFSEAFRQVKIGDPLDESTTLGPLSSKDALETLSKQVDEAVKNGATLHLGGKAVAREGNFFEPTILTGITRDNPAYFEEFFGPVAQIYVVKNDEEAIALANDSHYGLGGAVFSQDIERAKRMASAIETGMVYINWLTDTAPELPFGGVKRSGYGRELSDLGIKEFVNQKLVVVRR

SEQ ID NO: 13 - DNA, 1449 bp, Klebsiella sp.
  CDS (1)..(1449)
atgcaactcaacgatatgactctgtttcgccagcaggcgctgattgatggtcagtggcgcgatgcgcccaacggcgacgtgattgcggtgaccaacccggccaacggcgagcagctcggcagcgtgccgaaaatgggcgccgacgaaacccgacaagcgatcgaggccgctaaccgcgcccttcccgcctggcgtgccctcaccgccaaagagcgggcgaacattctgcgccgctggttcgatcttatgatggagaatcaggacgatctcgctcgtctgatgaccctcgagcaggggaaaccgctggcggaagccaaaggtgaaatcagctacgccgcctcctttattgaatggttcgctgaagaaggtaaacgcatttacggcgacaccattcctggccaccaggccgacaagcgcctgctggtgattaagcagcctatcggcgttaccgccgccatcaccccgtggaacttcccggcggcgatgatcacccgcaaagcgggcccggcgctggctgcgggctgcaccatggtcctgaaaccggccagccagacgccgttttctgcgctggcgctggccgaactggcgaatcgcgccgggatccccgccggggtgttcaacgtggtcaccggctcagccggcgcggtcggcggcgaactgaccagtaacccgctggtgcgcaagctctcctttaccggctcgaccgagattggccgccagctgatggagcagtgcgcgaaagacatcaaaaaagtctccctggagctgggcggcaacgcgccgtttatcgtcttcgacgatgccgacctcgacaaagccgtccagggggcgctggcatcgaagttccgcaacgccgggcaaacctgcgtctgcgctaaccgcctgtacgtccaggacggggtgtatgaccgtttcgccgagaagctgcagcaggcggtggaaaaactgcgcattggcgacggcctgcaggacggggtcaccaccggcccgctgatcgacgagaaagccgtcgccaaagttgaagaacacattgccgacgccatcgccaaaggcgcgaaggtggtcaccggcggcaaaccgcacgccctgggcggcaacttcttccagccgaccatcctggtcaacgttcctgacagcgccaaagtggcgaaggaggagaccttcggcccgctggcccctctgttccgctttaaagatgaagccgacgtcattgcccaggccaacgataccgagttcggcctcgccgcctatttctacgcccgcgatctgagccgcgtgttccgcgtcggcgaagcgctggagtacggcatcatcggcatcaataccggcattatctccaccgaagtcgctccgttcggcggcgttaaggcctccggcctcggccgcgaagggtcgaagtacggtatcgaagactacttagaaatcaaatacatgtgcattggcctttaa

SEQ ID NO: 14 - protein, 482 aa, Klebsiella sp.
MQLNDMTLFRQQALIDGQWRDAPNGDVIAVTNPANGEQLGSVPKMGADETRQAIEAANRALPAWRALTAKERANILRRWFDLMMENQDDLARLMTLEQGKPLAEAKGEISYAASFIEWFAEEGKRIYGDTIPGHQADKRLLVIKQPIGVTAAITPWNFPAAMITRKAGPALAAGCTMVLKPASQTPFSALALAELANRAGIPAGVFNVVTGSAGAVGGELTSNPLVRKLSFTGSTEIGRQLMEQCAKDIKKVSLELGGNAPFIVFDDADLDKAVQGALASKFRNAGQTCVCANRLYVQDGVYDRFAEKLQQAVEKLRIGDGLQDGVTTGPLIDEKAVAKVEEHIADAIAKGAKVVTGGKPHALGGNFFQPTILVNVPDSAKVAKEETFGPLAPLFRFKDEADVIAQANDTEFGLAAYFYARDLSRVFRVGEALEYGIIGINTGIISTEVAPFGGVKASGLGREGSKYGIEDYLEIKYMCIGL

SEQ ID NO: 15 - DNA, 1464 bp, Klebsiella sp.
  CDS (1)..(1464)
atggcagaacagcagctttatatccatggtggttatacatccgccaccagcggtcgcaccttcgagaccattaacccggccaacggtgaagtcctggcaagcgtacaggctgccggacgcgaggatgtcgaccgcgccgtcgagagcgcgcggcgtgggcaaaaaaactgggcggcgatgaccgccatggaacgctcgcgcattctgcgtcgcgccgtcgatatcctgcgcgaacggaacgacgagctggcaaagctggaaaccctcgacaccggtaaagcgtattccgaaacctcaaccgtggatatcgtcaccggcgcggacgtgctggagtattacgcggggctgatcccggcgctggaaggcagtcagatccccctgcgcgagacgtcgttcgtctacacccgccgcgaaccgctgggtgtggtggccgggattggcgcatggaactacccgatccagatcgctctgtggaaatccgccccggcgctggccgccggcaatgcgatgattttcaagccgagcgaagtgaccccgctcaccgccctgaaacttgcggaaatctataccgaagcgggtctgccggacggcgtgtttaacgtcctgccgggtgtaggcgcggagaccggccagtacctgaccgagcatccgggtatcgctaaagtctcctttaccggcggtgtcgccagcggcaaaaaggtgatggccaacgcggcgggctcgtccctgaaagaggtgacgatggagctgggcggcaaatcgccgctgattattttcgacgatgcggatctcgatctcgccgccgacatcgccatgatggccaactttttcagctccggccaggtgtgcaccaacggcacccgggtgttcgtccccgcgaaggttaaggcggcgtttgagcagaaaatcgttgagcgcgtgggccgcatccgtgcgggcgatctgttcgatgaacgcaccaactttggcccgctggtcagcttcccgcaccgtgacaatgtgctgcgctacatcgccaaaggcaaagcagaaggcgcgaacctgctgtgcggcggcgacgtgctgaagggcgaaggctttgacaacggcgcgtgggtggccccgaccgtgtttaccgactgcagcgatgagatgaccatcgtgcgcgaggagatcttcggcccggtgatgtccatcctcacctatgacaccgatgaagaagcgatccgccgcgccaacgataccgactacggtctggcggcgggtatcgtcacggccgacctgaaccgcgcccacagcgccattcatcagctcgaagcgggtatctgctggatcaacacctggggggaatccccggcggagatgccggtcggcggctataagcactccggcattggccgcgagaacggcgtgatgaccctgcagagttacacccaggtgaagtccatccaggttgagatgggtaaattccagtccatattttaa

SEQ ID NO: 16 - protein, 487 aa, Klebsiella sp.
MAEQQLYIHGGYTSATSGRTFETINPANGEVLASVQAAGREDVDRAVESARRGQKNWAAMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYTEAGLPDGVFNVLPGVGAETGQYLTEHPGIAKVSFTGGVASGKKVMANAAGSSLKEVTMELGGKSPLIIFDDADLDLAADIAMMANFFSSGQVCTNGTRVFVPAKVKAAFEQKIVERVGRIRAGDLFDERTNFGPLVSFPHRDNVLRYIAKGKAEGANLLCGGDVLKGEGFDNGAWVAPTVFTDCSDEMTIVREEIFGPVMSILTYDTDEEAIRRANDTDYGLAAGIVTADLNRAHSAIHQLEAGICWINTWGESPAEMPVGGYKHSGIGRENGVMTLQSYTQVKSIQVEMGKFQSIF

SEQ ID NO: 17 - DNA, 1479 bp, Klebsiella sp.
  CDS (1)..(1479)
atgagtctgtggattaacggcgaatggcggcccggcgatgggccgcgcttcagcaaacaggatccggtcaacctgaagattgtctggcagggcgaggcggcggatgccgggcaggttgccgaggcggtcgcggctgcccgccaggcgttcccggcctgggcgcggctgccgtttgccgaccgccaggccatcgtcgaaaagtttgccagtctgctggaggccagcaaggcggagctgacggcgattatcggcgccgagaccggaaagccgcgctgggaggcggccggggaagtgacggcgatgatcaacaaggtggcgatctcggtgaaggcgtatcacacccgcactggtgaacagcacagcgatctgcccgatggcgccgcgacgctgcgtcaccggccgcatggcgtgctggcggtctttggtccctataactttcccggccatctgccgaacgggcatatcgtgccggcgttgctggcgggcaatactgtggtatttaaacccagcgaattaaccccgcacagcggcgaagcggtggtgaagctgtgggagcaagctggcctgcccgccggcgtgctcaacctgctgcagggcggtcgggaaaccggcgaggcgctcagcggtcaggcggacatcgatgggctgctgtttaccggcagctcgaccaccggttttcatctgcatcgccagctggccgggcagccgcaaaagatcctcgcgctggagatgggcggcaataatccgctgatcgttgacgacccacgggacgtcgatgccgcggtgcatctgaccatccagtccgcctttattaccgccggccagcgctgcacctgcgcccgacgtctgctggtccggcgcggaaaggcgggggatgccttcctctccaggctggtgacggtcagccaacggctgatccccgcggcgtgggacgccgagccgcagccgtttctcggcgggcttatctctgaacaggccgcgcagaaagtgcatcaggcctggctgcagcgggtcgctgctggcgcggtcaccctgctggagccgcggttattgcaggccgggacgtcgctgctgacgccggggattgtcaacatgagcgacatgacccaggtcgaggatgaagaggtgttcggcccgctgcttggcgtctggcgctacgatactttcgaagaggcgattgccctggccaacgccacccgcttcggcctctcctgcgggttaatctccccggaacgagagaagttcgatcggctgctgcttgaggcacgggccgggatagtcaactggaacaaacccctgaccggggcggcgagtaccgcgccgttcggcggcaccggagcctcaggcaatcatcgccccggggcctggtatgccgcagattattgcgcctggccgatggccagtctcgaatcgccgaccctgacgctgcccgccagtctcaatccggggctcgacttccgggccggggaggcgttatga

SEQ ID NO: 18 - protein, 492 aa, Klebsiella sp.
MSLWINGEWRPGDGPRFSKQDPVNLKIVWQGEAADAGQVAEAVAAARQAFPAWARLPFADRQAIVEKFASLLEASKAELTAIIGAETGKPRWEAAGEVTAMINKVAISVKAYHTRTGEQHSDLPDGAATLRHRPHGVLAVFGPYNFPGHLPNGHIVPALLAGNTVVFKPSELTPHSGEAVVKLWEQAGLPAGVLNLLQGGRETGEALSGQADIDGLLFTGSSTTGFHLHRQLAGQPQKILALEMGGNNPLIVDDPRDVDAAVHLTIQSAFITAGQRCTCARRLLVRRGKAGDAFLSRLVTVSQRLIPAAWDAEPQPFLGGLISEQAAQKVHQAWLQRVAAGAVTLLEPRLLQAGTSLLTPGIVNMSDMTQVEDEEVFGPLLGVWRYDTFEEAIALANATRFGLSCGLISPEREKFDRLLLEARAGIVNWNKPLTGAASTAPFGGTGASGNHRPGAWYAADYCAWPMASLESPTLTLPASLNPGLDFRAGEAL

SEQ ID NO: 19 - DNA, 1416 bp, Klebsiella sp.
  CDS (1)..(1416)
atgtatattgatggccagttcgtttccggtcacggcgacggctggatcgacgtgcttaacccggcgaccgaagcgctgctgtcgcggatcccggacgggaccgcggaagaggcgcggctggcgattgacgcggcggagcgcgcccagccggcctgggaggcgctgccggccattgagcgcgcgggctggctgcgcaaaattgccgccggcatccgtcagcgtgccgatgacatcgccgggctgatcgtcgctgaaggcggcaagatccagcagctggcggcggtggaggtggcgttcaccgccgactatctcgactacatggccgaatgggcgcggcgttatgaaggggagatcgtgcagagcgaccgtcccggggaaaatatccttgtctttaaacgcgcgctgggggtgaccaccgggatcctgccgtggaacttcccgttttttcttatcgcccgcaagctggcgccggcgctgatcaccggaaataccatcgtcattaagcccagcgaattcacgcccaataacgctattgctttcgccgagatcgtccaccagattgggctgccgaaaggggtctttaacctggtgctcggccgtggggaaaccgtcggccaggagctggccggcaatccgaaggtggcgatggtcagcatgaccggcagcgtggcggcgggggagaaaatcatggccgccgcggcgaaaaatatcaccaaagtgtgccttgagcttggcggcaaagcgccggccatcgtcatggacgatgcggatgtggagctggcggtgaaagcggtggtggactcgcgggtgatcaacaccgggcaggtgtgcaactgcgtcgagcgggtctatgttcagcaggggatttacgaccgcttcgtcaaccgcctcggcgaggcgatgaaggccgtgcagtttggcgacccggcggcgcgggatgacatcgcgatggggccgctgatcaacgctgccgcgcgggatcaggtggcgcgcaaagtggcgaaggcggtggcgcagggggcgcgggtagcgctgggcggtcagccgctggaggggaaaggctatttttatccgccgaccctgctgctggatgtgcgtcaggagatggatattatccatgaggaaaccttcggtccggtgctgccggtggtggcgttttcaactctcgatgaagcgctggcgatggccaatgacagcgattatggcctcacctcctcaatctacacccgcgatctcaacgtggcgatgaaggcgattaaggggctgaagttcggcgaaacctatatcaaccgcgagaactttgaggcgatgcagggattccacgccggctggcgtaaatcagggatcggcggcgcagatggccgccatggcctgaatgagtacctgcagacccaggtggtctatctgcaggcctga

SEQ ID NO: 20 - protein, 471 aa, Klebsiella sp.
MYIDGQFVSGHGDGWIDVLNPATEALLSRIPDGTAEEARLAIDAAERAQPAWEALPAIERAGWLRKIAAGIRQRADDIAGLIVAEGGKIQQLAAVEVAFTADYLDYMAEWARRYEGEIVQSDRPGENILVFKRALGVTTGILPWNFPFFLIARKLAPALITGNTIVIKPSEFTPNNAIAFAEIVHQIGLPKGVFNLVLGRGETVGQELAGNPKVAMVSMTGSVAAGEKIMAAAAKNITKVCLELGGKAPAIVMDDADVELAVKAVVDSRVINTGQVCNCVERVYVQQGIYDRFVNRLGEAMKAVQFGDPAARDDIAMGPLINAAARDQVARKVAKAVAQGARVALGGQPLEGKGYFYPPTLLLDVRQEMDIIHEETFGPVLPVVAFSTLDEALAMANDSDYGLTSSIYTRDLNVAMKAIKGLKFGETYINRENFEAMQGFHAGWRKSGIGGADGRHGLNEYLQTQVVYLQA

SEQ ID NO: 21 - DNA, 1470 bp, Klebsiella sp.
  CDS (1)..(1470)
atggacgaattagacatttttatcggcggccagtggcgtcgcggcggcggcaatttgatgcacagccagtttccggcggatggcgctattaacgcggcgctgcatgcggcaagcctcgatgatctgcaggaggcgatcgactgtgccgaccgcgcctggcgggagccaacgtggcgggcgatgctgccgcatcagcgggcgaagatcctgcataaggtcgcggaactgatagaggtgcaacttgatgagttaagccaaaagcagagccgcgataacggtaagccgctggctgaggcgcggggactggtgatgagcgcggcggggacggcgcgctattttgccgccgcctgtgaactgctggagggcgagctgccgacgccgcggcaggcggatcgattgaccctgagccgctatgagccgctgggcgtggtggcggcgatcaccccgtggaactcgccgatcgccagcgaaatgcagaaggtggccccggcgatcgccgccggaaatgcggtgatcctcaaaccggcggaagccacgccgctgatggcgctggagctggcgaagatctttgagcaggccggtttacccgccggactgctgagtgtgctgccgggtaaaggatcgattatcggcgatgcgctggcccgccatcctaaggtgcgcaaaatttcctttaccggcggcaccaccaccggacgtcacctggcgcatgtggcggcggaaaaactgatcccggcgtcgctggagctgggcggcaaatcaccgaccatcgtgctggaagatgccgatatcgaacaggcggcgcggggcatctgctacggcattttcagctccggcggccaggcctgtattgccggctcgcggctgtttgttcatgacagagtgtacccgcaattaatggcccgcctgctggagttaacccaagggctgcgggttggtcacccgttcaacgctggcacccacgtcgggccgctgatcaacgataaacaccgccagagcgtgcaggagtacgtcgagctggcgaaacgcgaaggcggcagggtgctatgcggcggcgagatcccggcggatccggcgctggcggcaggcagctatttcctgccgaccatcattgaagggctgaacaatcaggcccgcgtttgccaggaagagatcttcgggccggtgctggtggcgatgcgttttcgcgatgaagcggcgttaatccgtgaggccaatgattcggtctttgggctggcggcggggatctggacgcgcgataccggccgcgcgctgcgtctgagcgagcagctggaagccggtacggtgtggatcaacacctacaaagttttctccatttcgaccccgtttgggggctttaaagagagtggtctgggccgcgaaaaagggatccaggggctgaaagcctggatgcagcaaaagagcatttatctggcgacgggtaatagcgtcaaccactggtgcgactga

SEQ ID NO: 22 - protein, 489 aa, Klebsiella sp.
MDELDIFIGGQWRRGGGNLMHSQFPADGAINAALHAASLDDLQEAIDCADRAWREPTWRAMLPHQRAKILHKVAELIEVQLDELSQKQSRDNGKPLAEARGLVMSAAGTARYFAAACELLEGELPTPRQADRLTLSRYEPLGVVAAITPWNSPIASEMQKVAPAIAAGNAVILKPAEATPLMALELAKIFEQAGLPAGLLSVLPGKGSIIGDALARHPKVRKISFTGGTTTGRHLAHVAAEKLIPASLELGGKSPTIVLEDADIEQAARGICYGIFSSGGQACIAGSRLFVHDRVYPQLMARLLELTQGLRVGHPFNAGTHVGPLINDKHRQSVQEYVELAKREGGRVLCGGEIPADPALAAGSYFLPTIIEGLNNQARVCQEEIFGPVLVAMRFRDEAALIREANDSVFGLAAGIWTRDTGRALRLSEQLEAGTVWINTYKVFSISTPFGGFKESGLGREKGIQGLKAWMQQKSIYLATGNSVNHWCD

SEQ ID NO: 23 - DNA, 1488 bp, Escherichia coli
  CDS (1)..(1488)
atgaattttcatcatctggcttactggcaggataaagcgttaagtctcgccattgaaaaccgcttatttattaacggtgaatatactgctgcggcggaaaatgaaacctttgaaaccgttgatccggtcacccaggcaccgctggcgaaaattgcccgcggcaagagcgtcgatatcgaccgtgcgatgagcgcagcacgcggcgtatttgaacgcggcgactggtcactctcttctccggctaaacgtaaagcggtactgaataaactcgccgatttaatggaagcccacgccgaagagctggcactgctggaaactctcgacaccggcaaaccgattcgtcacagtctgcgtgatgatattcccggcgcggcgcgcgccattcgctggtacgccgaagcgatcgacaaagtgtatggcgaagtggcgaccaccagtagccatgagctggcgatgatcgtgcgtgaaccggtcggcgtgattgccgccatcgtgccgtggaacttcccgctgttgctgacttgctggaaactcggcccggcgctggcggcgggaaacagcgtgattctaaaaccgtctgaaaaatcaccgctcagtgcgattcgtctcgcggggctggcgaaagaagcaggcttgccggatggtgtgttgaacgtggtgacgggttttggtcatgaagccgggcaggcgctgtcgcgtcataacgatatcgacgccattgcctttaccggttcaacccgtaccgggaaacagctgctgaaagatgcgggcgacagcaacatgaaacgcgtctggctggaagcgggcggcaaaagcgccaacatcgttttcgctgactgcccggatttgcaacaggcggcaagcgccaccgcagcaggcattttctacaaccagggacaggtgtgcatcgccggaacgcgcctgttgctggaagagagcatcgccgatgaattcttagccctgttaaaacagcaggcgcaaaactggcagccgggccatccacttgatcccgcaaccaccatgggcaccttaatcgactgcgcccacgccgactcggtccatagctttattcgggaaggcgaaagcaaagggcaactgttgttggatggccgtaacgccgggctggctgccgccatcggcccgaccatctttgtggatgtggacccgaatgcgtccttaagtcgcgaagagattttcggtccggtgctggtggtcacgcgtttcacatcagaagaacaggcgctacagcttgccaacgacagccagtacggccttggcgcggcggtatggacgcgcgacctctcccgcgcgcaccgcatgagccgacgcctgaaagccggttccgtcttcgtcaataactacaacgacggcgatatgaccgtgccgtttggcggctataagcagagcggcaacggtcgcgacaaatccctgcatgcccttgaaaaattcactgaactgaaaaccatctggataagcctggaggcctga

SEQ ID NO: 24 - protein, 495 aa, Escherichia coli
MNFHHLAYWQDKALSLAIENRLFINGEYTAAAENETFETVDPVTQAPLAKIARGKSVDIDRAMSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQQAASATAAGIFYNQGQVCIAGTRLLLEESIADEFLALLKQQAQNWQPGHPLDPATTMGTLIDCAHADSVHSFIREGESKGQLLLDGRNAGLAAAIGPTIFVDVDPNASLSREEIFGPVLVVTRFTSEEQALQLANDSQYGLGAAVWTRDLSRAHRMSRRLKAGSVFVNNYNDGDMTVPFGGYKQSGNGRDKSLHALEKFTELKTIWISLEA

SEQ ID NO: 25 - DNA, 1500 bp, Escherichia coli
  CDS (1)..(1500)
atgacagagccgcatgtagcagtattaagccaggtccaacagtttctcgatcgtcaacacggtctttatattgatggtcgtcctggccccgcacaaagtgaaaaacggttggcgatctttgatccggccaccgggcaagaaattgcgtctactgctgatgccaacgaagcggatgtagataacgcagtcatgtctgcctggcgggcctttgtctcgcgtcgctgggccgggcgattacccgcagagcgtgaacgtattctgctacgttttgctgatctggtggagcagcacagtgaggagctggcgcaactggaaaccctggagcaaggcaagtcaattgccatttcccgtgcttttgaagtgggctgtacgctgaactggatgcgttataccgccgggttaacgaccaaaatcgcgggtaaaacgctggacttgtcgattcccttaccccagggggcgcgttatcaggcctggacgcgtaaagagccggttggcgtagtggcgggaattgtgccatggaactttccgttgatgattggtatgtggaaggtgatgccagcactggcagcaggctgttcaatcgtgattaagccttcggaaaccacgccactgacgatgttgcgcgtggcggaactggccagcgaggctggtatccctgatggcgtttttaatgtcgtcaccgggtcaggtgctgtatgcggcgcggccctgacgtcacatcctcatgttgcgaaaatcagttttaccggttcaaccgcgacgggaaaaggtattgccagaactgctgctgatcacttaacgcgtgtaacgctggaactgggcggtaaaaacccggcaattgtattaaaagatgctgatccgcaatgggttattgaaggcttgatgaccggaagcttcctgaatcaagggcaagtatgcgccgccagttcgcgaatttatattgaagcgccgttgtttgacacgctggttagtggatttgagcaggcggtaaaatcgttgcaagtgggaccggggatgtcacctgttgcacagattaaccctttggtttctcgtgcgcactgcgacaaagtgtgttcattcctcgacgatgcgcaggcacagcaagcagagctgattcgcgggtcgaatggaccagccggagaggggtattatgttgcgccaacgctggtggtaaatcccgatgctaaattgcgcttaactcgtgaagaggtgtttggtccggtggtaaacctggtgcgagtagcggatggagaagaggcgttacaactggcaaacgacacggaatatggcttaactgccagtgtctggacgcaaaatctctcccaggctctggaatatagcgatcgcttacaggcagggacggtgtgggtaaacagccataccttaattgacgctaacttaccgtttggtgggatgaagcagtcaggaacgggccgtgattttggccccgactggctggacggttggtgtgaaactaagtcggtgtgtgtacggtattaa

SEQ ID NO: 26 - protein, 499 aa, Escherichia coli
MTEPHVAVLSQVQQFLDRQHGLYIDGRPGPAQSEKRLAIFDPATGQEIASTADANEADVDNAVMSAWRAFVSRRWAGRLPAERERILLRFADLVEQHSEELAQLETLEQGKSIAISRAFEVGCTLNWMRYTAGLTTKIAGKTLDLSIPLPQGARYQAWTRKEPVGVVAGIVPWNFPLMIGMWKVMPALAAGCSIVIKPSETTPLTMLRVAELASEAGIPDGVFNVVTGSGAVCGAALTSHPHVAKISFTGSTATGKGIARTAADHLTRVTLELGGKNPAIVLKDADPQWVIEGLMTGSFLNQGQVCAASSRIYIEAPLFDTLVSGFEQAVKSLQVGPGMSPVAQINPLVSRAHCDKVCSFLDDAQAQQAELIRGSNGPAGEGYYVAPTLVVNPDAKLRLTREEVFGPVVNLVRVADGEEALQLANDTEYGLTASVWTQNLSQALEYSDRLQAGTVWVNSHTLIDANLPFGGMKQSGTGRDFGPDWLDGWCETKSVCVRY

SEQ ID NO: 27 - DNA, 1449 bp, Escherichia coli
  CDS (1)..(1449)
atgaaacttaacgacagtaacttattccgccagcaggcgttgattaacggggaatggctggacgccaacaatggtgaagccatcgacgtcaccaatccggcgaacggcgacaagctgggtagcgtgccgaaaatgggcgcggatgaaacccgcgccgctatcgacgccgccaaccgcgccctgcccgcctggcgcgcgctcaccgccaaagaacgcgccaccattctgcgcaactggttcaatttgatgatggagcatcaggacgatttagcgcgcctgatgaccctcgaacagggtaaaccactggccgaagcgaaaggcgaaatcagctacgccgcctcctttattgagtggtttgccgaagaaggcaaacgcatttatggcgacaccattcctggtcatcaggccgataaacgcctgattgttatcaagcagccgattggcgtcaccgcggctatcacgccgtggaacttcccggcggcgatgattacccgcaaagccggtccggcgctggcagcaggctgcaccatggtgctgaagcccgccagtcagacgccgttctctgcgctggcgctggcggagctggcgatccgcgcgggcgttccggctggggtatttaacgtggtcaccggttcggcgggcgcggtcggtaacgaactgaccagtaacccgctggtgcgcaaactgtcgtttaccggttcgaccgaaattggccgccagttaatggaacagtgcgcgaaagacatcaagaaagtgtcgctggagctgggcggtaacgcgccgtttatcgtctttgacgatgccgacctcgacaaagccgtggaaggcgcgctggcctcgaaattccgcaacgccgggcaaacctgcgtctgcgccaaccgcctgtatgtgcaggacggcgtgtatgaccgttttgccgaaaaattgcagcaggcagtgagcaaactgcacatcggcgacgggctggataacggcgtcaccatcgggccgctgatcgatgaaaaagcggtagcaaaagtggaagagcatattgccgatgcgctggagaaaggcgcgcgcgtggtttgcggcggtaaagcgcacgaacgcggcggcaacttcttccagccgaccattctggtggacgttccggccaacgccaaagtgtcgaaagaagagacgttcggccccctcgccccgctgttccgctttaaagatgaagctgatgtgattgcgcaagccaatgacaccgagtttggccttgccgcctatttctacgcccgtgatttaagccgcgtcttccgcgtgggcgaagcgctggagtacggcatcgtcggcatcaataccggcattatttccaatgaagtggccccgttcggcggcatcaaagcctcgggtctgggtcgtgaaggttcgaagtatggcatcgaagattacttagaaatcaaatatatgtgcatcggtctttaa

SEQ ID NO: 28 - protein, 482 aa, Escherichia coli
MKLNDSNLFRQQALINGEWLDANNGEAIDVTNPANGDKLGSVPKMGADETRAAIDAANRALPAWRALTAKERATILRNWFNLMMEHQDDLARLMTLEQGKPLAEAKGEISYAASFIEWFAEEGKRIYGDTIPGHQADKRLIVIKQPIGVTAAITPWNFPAAMITRKAGPALAAGCTMVLKPASQTPFSALALAELAIRAGVPAGVFNVVTGSAGAVGNELTSNPLVRKLSFTGSTEIGRQLMEQCAKDIKKVSLELGGNAPFIVFDDADLDKAVEGALASKFRNAGQTCVCANRLYVQDGVYDRFAEKLQQAVSKLHIGDGLDNGVTIGPLIDEKAVAKVEEHIADALEKGARVVCGGKAHERGGNFFQPTILVDVPANAKVSKEETFGPLAPLFRFKDEADVIAQANDTEFGLAAYFYARDLSRVFRVGEALEYGIVGINTGIISNEVAPFGGIKASGLGREGSKYGIEDYLEIKYMCIGL

SEQ ID NO: 29 - DNA, 1539 bp, Escherichia coli
  CDS (1)..(1539)
atgaccaataatcccccttcagcacagattaagcccggcgagtatggtttccccctcaagttaaaagcccgctatgacaactttattggcggcgaatgggtagcccctgccgacggcgagtattaccagaatctgacgccggtgaccgggcagctgctgtgcgaagtggcgtcttcgggcaaacgagacatcgatctggcgctggatgctgcgcacaaagtgaaagataaatgggcgcacacctcggtgcaggatcgtgcggcgattctgtttaagattgccgatcgaatggaacaaaacctcgagctgttagcgacagctgaaacctgggataacggcaaacccattcgcgaaaccagtgctgcggatgtaccgctggcgattgaccatttccgctatttcgcctcgtgtattcgggcgcaggaaggtgggatcagtgaagttgatagcgaaaccgtggcctatcatttccatgaaccgttaggcgtggtggggcagattatcccgtggaacttcccgctgctgatggcgagctggaaaatggctcccgcgctggcggcgggcaactgtgtggtgctgaaacccgcacgtcttaccccgctttctgtactgctgctaatggaaattgtcggtgatttactgccgccgggcgtggtgaacgtggtcaatggcgcaggtggggtaattggcgaatatctggcgacctcgaaacgcatcgccaaagtggcgtttaccggctcaacggaagtgggccaacaaattatgcaatacgcaacgcaaaacattattccggtgacgctggagttgggcggtaagtcgccaaatatcttctttgctgatgtgatggatgaagaagatgcctttttcgataaagcgctggaaggctttgcactgtttgcctttaaccagggcgaagtttgcacctgtccgagtcgtgctttagtgcaggaatctatctacgaacgctttatggaacgcgccatccgccgtgtcgaaagcattcgtagcggtaacccgctcgacagcgtgacgcaaatgggcgcgcaggtttctcacgggcaactggaaaccatcctcaactacattgatatcggtaaaaaagagggcgctgacgtgctcacaggcgggcggcgcaagctgctggaaggtgaactgaaagacggctactacctcgaaccgacgattctgtttggtcagaacaatatgcgggtgttccaggaggagatttttggcccggtgctggcggtgaccaccttcaaaacgatggaagaagcgctggagctggcgaacgatacgcaatatggcctgggcgcgggcgtctggagccgcaacggtaatctggcctataagatggggcgcggcatacaggctgggcgcgtgtggaccaactgttatcacgcttacccggcacatgcggcgtttggtggctacaaacaatcaggtatcggtcgcgaaacccacaagatgatgctggagcattaccagcaaaccaagtgcctgctggtgagctactcggataaaccgttggggctgttctga

SEQ ID NO: 30 - protein, 512 aa, Escherichia coli
MTNNPPSAQIKPGEYGFPLKLKARYDNFIGGEWVAPADGEYYQNLTPVTGQLLCEVASSGKRDIDLALDAAHKVKDKWAHTSVQDRAAILFKIADRMEQNLELLATAETWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEIVGDLLPPGVVNVVNGAGGVIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSVTQMGAQVSHGQLETILNYIDIGKKEGADVLTGGRRKLLEGELKDGYYLEPTILFGQNNMRVFQEEIFGPVLAVTTFKTMEEALELANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 31 - DNA, 1479 bp, Escherichia coli
  CDS (1)..(1479)
atgactttatggattaacggtgactggataacgggccagggcgcatcgcgtgtgaagcgtaatccggtatcgggcgaggtgttatggcaaggcaatgatgccgatgccgctcaggtcgagcaggcttgtcgggcagcccgtgcggcgtttccgcgctgggcgcggctttcatttgctgaacgtcatgccgttgtcgaacgctttgccgcactgctggaaagcaataaagccgaattaaccgcgattattgccagagaaacgggtaagccgcgctgggaagcggcaaccgaagtgacggcgatgatcaataaaatcgcgatatcaattaaggcgtatcacgttcgtaccggcgagcagcgtagtgaaatgccggacggcgcggcgagcctgcgacatcgcccgcacggcgtgctggcggtgtttgggccgtataatttccctggtcatttgccgaacggacatatcgttccggcattgctggcaggtaacaccattatctttaaacccagcgaactgacaccgtggagtggcgaagcggtaatgcgtttatggcagcaggctggcttgccgccaggcgtgctgaacctggtgcagggcgggcgtgaaacgggtcaggcgctgagtgcgctggaggatctcgacggtttgctgtttaccggtagcgccaatacaggctaccagttgcatcgccagctctccggtcagccggagaaaattctcgcccttgagatgggcggtaataatccgctaattatcgatgaggtggcggatatcgacgcggctgtccatctgaccattcagtcggcgtttgtcacagccggtcaacgctgcacctgcgcccgccgtttattgctgaaaagcggggcgcagggcgatgcgtttcttgctcgtctggttgccgtcagccagcgattaacgccgggcaactgggatgacgaaccgcagccgtttattggcgggctgatttctgaacaggccgcacagcaggtggttactgcatggcagcaactggaagcgatgggcggacgacccctgcttgcgccgcgcttattacaagcagggacatcgttgctgacgccggggatcattgaaatgacaggcgttgctggcgtaccagatgaagaggtgttcggaccgttattgcgcgtctggcgttatgatactttcgatgaagcgattcgaatggcgaataacactcgcttcggactctcttgcggtctggtttcccccgagcgggaaaagttcgatcaactgttgctggaggcgcgggcggggattgttaactggaacaaaccgcttaccggtgctgccagtaccgcgccattcggcggcattggtgcttccggtaaccatcgccccagcgcctggtatgccgcagattactgcgcatggccgatggcgagcctggagtcggactcgttaacattgcccgccacgcttaaccccgggctggatttttccgatgaggtggtgcgatga

SEQ ID NO: 32 - protein, 492 aa, Escherichia coli
MTLWINGDWITGQGASRVKRNPVSGEVLWQGNDADAAQVEQACRAARAAFPRWARLSFAERHAVVERFAALLESNKAELTAIIARETGKPRWEAATEVTAMINKIAISIKAYHVRTGEQRSEMPDGAASLRHRPHGVLAVFGPYNFPGHLPNGHIVPALLAGNTIIFKPSELTPWSGEAVMRLWQQAGLPPGVLNLVQGGRETGQALSALEDLDGLLFTGSANTGYQLHRQLSGQPEKILALEMGGNNPLIIDEVADIDAAVHLTIQSAFVTAGQRCTCARRLLLKSGAQGDAFLARLVAVSQRLTPGNWDDEPQPFIGGLISEQAAQQVVTAWQQLEAMGGRPLLAPRLLQAGTSLLTPGIIEMTGVAGVPDEEVFGPLLRVWRYDTFDEAIRMANNTRFGLSCGLVSPEREKFDQLLLEARAGIVNWNKPLTGAASTAPFGGIGASGNHRPSAWYAADYCAWPMASLESDSLTLPATLNPGLDFSDEVVR

SEQ ID NO: 33 - DNA, 44 bp, Artificial Sequence
  Synthetic DNA
cggtacccggggatcccaatatgccgctgcgtctcaaccctaca

SEQ ID NO: 34 - DNA, 41 bp, Artificial Sequence
  Synthetic DNA
cgactctagaggatccacccgaatggattgcggactgagga

SEQ ID NO: 35 - DNA, 41 bp, Artificial Sequence
  Synthetic DNA
cggtacccggggatccatcttgatgttcatcgcgttaccct

SEQ ID NO: 36 - DNA, 43 bp, Artificial Sequence
  Synthetic DNA
cgactctagaggatcccgattaatatcgcaccatcaccgactt

SEQ ID NO: 37 - DNA, 44 bp, Artificial Sequence
  Synthetic DNA
cggtacccggggatcccgcgatgaataaggaaagggtatgtcca

SEQ ID NO: 38 - DNA, 41 bp, Artificial Sequence
  Synthetic DNA
cgactctagaggatccagattgccctccacagtagcgagaa

SEQ ID NO: 39 - DNA, 42 bp, Artificial Sequence
  Synthetic DNA
cggtacccggggatcctggtaacgacgataccaatcttaggg

SEQ ID NO: 40 - DNA, 41 bp, Artificial Sequence
  Synthetic DNA
cgactctagaggatcctgtgactattagcggcctaacacac

SEQ ID NO: 41 - DNA, 42 bp, Artificial Sequence
  Synthetic DNA
cggtacccggggatccagtagcgataacaaggagacatgcga

SEQ ID NO: 42 - DNA, 41 bp, Artificial Sequence
  Synthetic DNA
cgactctagaggatcccatgtgagcgttgacggtaaagagg

SEQ ID NO: 43 - DNA, 46 bp, Artificial Sequence
  Synthetic DNA
cggtacccggggatccccctgaagacaggaagcaattatgcaactc

SEQ ID NO: 44 - DNA, 41 bp, Artificial Sequence
  Synthetic DNA
cgactctagaggatcctcgctcctgttaaaggccaatgcac

SEQ ID NO: 45 - DNA, 41 bp, Artificial Sequence
  Synthetic DNA
cggtacccggggatcctattcgtcagcatttaccgaaccca

SEQ ID NO: 46 - DNA, 45 bp, Artificial Sequence
  Synthetic DNA
cgactctagaggatccccggttaaaatatggactggaatttaccc

SEQ ID NO: 47 - DNA, 46 bp, Artificial Sequence
  Synthetic DNA
cggtacccggggatccatccctgaggagaaaactgcatgagtctgt

SEQ ID NO: 48 - DNA, 41 bp, Artificial Sequence
  Synthetic DNA
cgactctagaggatccaaaggagagcccggcgtagtgatgg

SEQ ID NO: 49 - DNA, 41 bp, Artificial Sequence
  Synthetic DNA
cggtacccggggatccagccatgacagcacccgttcaacac

SEQ ID NO: 50 - DNA, 41 bp, Artificial Sequence
  Synthetic DNA
cgactctagaggatccgtgcctcaggcctgcagatagacca

SEQ ID NO: 51 - DNA, 42 bp, Artificial Sequence
  Synthetic DNA
cggtacccggggatccgcataacgcagagaggctgagatgga

SEQ ID NO: 52 - DNA, 41 bp, Artificial Sequence
  Synthetic DNA
cgactctagaggatccccctttctcagtcgcaccagtggtt

SEQ ID NO: 53 - DNA, 38 bp, Artificial Sequence
  Synthetic DNA
cggtacccggggatccatctgatagacgtgaaacagga

SEQ ID NO: 54 - DNA, 36 bp, Artificial Sequence
  Synthetic DNA
cgactctagaggatccgaggcttcgagaaccactac

SEQ ID NO: 55 - DNA, 36 bp, Artificial Sequence
  Synthetic DNA
cggtacccggggatcctgtcacgatttgcggagctt

SEQ ID NO: 56 - DNA, 40 bp, Artificial Sequence
  Synthetic DNA
cgactctagaggatccaccatggaacttctttgacgaaac

SEQ ID NO: 57 - DNA, 38 bp, Artificial Sequence
  Synthetic DNA
cggtacccggggatccctttgaaaacaggatgtagcga

SEQ ID NO: 58 - DNA, 36 bp, Artificial Sequence
  Synthetic DNA
cgactctagaggatccccagttaaagaccgatgcac

SEQ ID NO: 59 - DNA, 36 bp, Artificial Sequence
  Synthetic DNA
cggtacccggggatccatacctcacaccgcaaggag

SEQ ID NO: 60 - DNA, 41 bp, Artificial Sequence
  Synthetic DNA
cgactctagaggatcccgaccagcttcttatatcagaacag

SEQ ID NO: 61 - DNA, 41 bp, Artificial Sequence
  Synthetic DNA
cggtacccggggatcccgtttgattttaaccgccgcacaac

SEQ ID NO: 62 - DNA, 36 bp, Artificial Sequence
  Synthetic DNA
cgactctagaggatcccttcccaggcgttcatcgca

SEQ ID NO: 63 - DNA, 50 bp, Artificial Sequence
  Synthetic DNA
accacagccaggatccgcgttatgcacaccctggccagcccggcgccctg

SEQ ID NO: 64 - DNA, 49 bp, Artificial Sequence
  Synthetic DNA
gctcgaattcggatcctcagaacaggcccagcggcgcggtgccgtagct

SEQ ID NO: 65 - DNA, 3459 bp, Corynebacterium glutamicum
  CDS (1)..(3459)
atgacgtcgatgaatctgcctattgagttggctacgctgtctgaccaggctgtggacaaggtgcgctcctggctggagtacagcaaaaaggaaagcgtgcccaatgccgatgcgaagcgtctagctgcagtgttgcaggatcctaatggtttggaattcacggttggtttcgtggatcgagtggttcgaactgaggatcgtgaagcggcagcgcatgcgttgtatgagttgggcaagattgctccgtcgacgatgtcctttttggatcgggcgcagattcaggccggttctttggtggggcgggcgttgccgcaggttgtggttcctgcggcgcgggctcgaatccggcagatggttgggcacatgattgtggatgcccgcgacaagcagttcgccaaggctgtcgctgagattcagtcggatgggcaccgcctgaacatcaatttgctaggtgaagcggtgttgggccgaaaggaggcagcgaagcatttggatgacacggtgcggttgttgcgccgtccggatgtggaatatgtgtccatcaaggtctcttcggtggcatcgcagatttcgatgtggggtttcgaagacaccgttaattatgttgtggaacagctgacacctttatatatagaggccgcgcgggcgccgaaaggcacgaagttcatcaacctggacatggaggaataccgcgatctgcgcctgactatggaggtgttcaagcggctgctctccaatccagagctgcatgaactagaagccggaattgtgttgcaggcgtaccttcccgatgccctcggtgcaatccaggacttggcgcagttcggccgcgagcgcgtcaacacaggcggggcgggcgttaaggttcgcctggtcaagggtgctaatttgcctatggagcacgtccacgcgcagatcaccggctggccagttgccacagaaccttccaaacaagccaccgatgccaattacaagcgcgtcctctattggacgatgcgcaaagaaaacatggagggcctgcgcctgggcgttgccggccacaaccttttcgacatagcattcgcacatttgctctctgtggagcgtggggtagcggaccgtgtggagttcgaaatgctgcagggcatggcgtccgatcaggcgcgcgccgtcagcgttgacgtcggtgagctgctgctttacgtaccagccgtgcgcccacaagaattcgacgtggccatttcttacctcgtgcgccgcctcgaggaaaacgccgcgagcgaaaacttcatgtccgccatcttcgacctcgacgccgacaacccgtccttcaagcgagaggagagccgcttccgcgcctccatatctgacctcgccacgctcatcgacgtgcccgcgcccggccccaaccacacacaagaccgcagcaaagagacgcttctcgacgcccccctcgtcccatttatcaacgagcccgacaccaacccagcgctcatccaaaaccaacagtgggccacaaaagccgtcgccaccgcagcagagcccggttggttggaaaaacaaacaaagccggaggtgttggaagagggggacgtcgacaagctaattaacgatgtgcgcgacgctgctgaagcgtgggcagcgcgcccagcccgtgaacgcgctgagattttgtacaagaccgccgagattttgcgcgtgcgacgcggacacctgatctcagtgacggccgcggaggtgggcaaagctgtggaacaaaccgacccggaaatctctgaagccattgatttcgcccgctactacgcgcatttggccctggaattggacgacgtagacaatgcggaattcaccccagatcgcgtcgttgtggtgaccccgccctggaatttccccatcgcgatccccgctggatcgactttcgcagcactcgcggcgggcgctggcgtgatccacaaaccctcaaagcctagccaacattgctccgctgcagtggtcgaagccctctgggaagccggcgttccccgcgaggttctgcattgcatttacccagctaatcgcgatgttggatgtgcgttgatcagccatgaacacgtcgaccgcgtcattttgaccggctcctccgagaccgccgcgatgttctcctcctggcgaccagaactcaccatcaacggcgaaacctccggcaaaaacgccatcgtggtcaccccatctgccgaccgcgacctcgccgtcgccgacctggtgaaatccgccttcggccatgcaggacaaaaatgttccgcagcctccctcggcatcttggtaggcagcgtctacgaatcagaacgcttccggaaacagctggtagacgccgcatcctcactcatcgtcgactggcctaccaacccctccgcaaccgtcggaccactcaccgaactccccagcgataaactccaccacgccctaaccaccctcgaagaaggagaaagctggctgctgaaaccccgacaactcgacgacaccggccgactctggtcacccggcatcaaagaaggcgtcaaaccaggaaccttcttccacctcacagaagtattcggaccagtcctcggcctgatgaaagccaccgacctcaatgaagccatcgaattccaaaacggcaacgacttcggactcaccggcggactccaatccctcgacgccgacgaagtccgcacctggcttgaccacgtcgatgtcggaaacgcctacgtcaaccgcggcatcaccggcgccattgtccaacgccaatccttcggaggctggaaaaaatcctccgtcggcctcggatccaaagccggaggacccaactatgtcatgctcatgggaacctgggccgacgcgccaagccaccacgccccacgcgaaacaaacccgctgatcagcaaactggatctccccggagaagagctcgaatggctcgaaaaagccaacgccagcgatgaaacagcatggaacacggaattcggcagcccacgcgacccctccggcctcgatgtagaagccaacattttccgctaccgaccagcagaggtagtactccgactcgacgattccgccacaccccgagaaactgcccgcgcattgttggcagcccgtcgcgccggggttactccgcgagttcttcaaacaccaggtgtttcagagcaagtccgcgaagtattgtccgctgctggagtgagtgcagaaacagtcgatgattcggtatttatttccaacgtgttgcgcggcgaatacgacgagaactccagcgtccgagtccgctacctgggcaaagttagcgacactgtccgtgaacgcctatctgtacggcccgaagttgttctgcttgacgatgcagtaactgcctccggtcgagttgaattacgttactggctcaaagaacaagcaatttccatgacgttgcaccgttttggaaacccagttgcggccttccacgagttggcggaggaacttaaacgttga

SEQ ID NO: 66 - protein, 1152 aa, Corynebacterium glutamicum
MTSMNLPIELATLSDQAVDKVRSWLEYSKKESVPNADAKRLAAVLQDPNGLEFTVGFVDRVVRTEDREAAAHALYELGKIAPSTMSFLDRAQIQAGSLVGRALPQVVVPAARARIRQMVGHMIVDARDKQFAKAVAEIQSDGHRLNINLLGEAVLGRKEAAKHLDDTVRLLRRPDVEYVSIKVSSVASQISMWGFEDTVNYVVEQLTPLYIEAARAPKGTKFINLDMEEYRDLRLTMEVFKRLLSNPELHELEAGIVLQAYLPDALGAIQDLAQFGRERVNTGGAGVKVRLVKGANLPMEHVHAQITGWPVATEPSKQATDANYKRVLYWTMRKENMEGLRLGVAGHNLFDIAFAHLLSVERGVADRVEFEMLQGMASDQARAVSVDVGELLLYVPAVRPQEFDVAISYLVRRLEENAASENFMSAIFDLDADNPSFKREESRFRASISDLATLIDVPAPGPNHTQDRSKETLLDAPLVPFINEPDTNPALIQNQQWATKAVATAAEPGWLEKQTKPEVLEEGDVDKLINDVRDAAEAWAARPARERAEILYKTAEILRVRRGHLISVTAAEVGKAVEQTDPEISEAIDFARYYAHLALELDDVDNAEFTPDRVVVVTPPWNFPIAIPAGSTFAALAAGAGVIHKPSKPSQHCSAAVVEALWEAGVPREVLHCIYPANRDVGCALISHEHVDRVILTGSSETAAMFSSWRPELTINGETSGKNAIVVTPSADRDLAVADLVKSAFGHAGQKCSAASLGILVGSVYESERFRKQLVDAASSLIVDWPTNPSATVGPLTELPSDKLHHALTTLEEGESWLLKPRQLDDTGRLWSPGIKEGVKPGTFFHLTEVFGPVLGLMKATDLNEAIEFQNGNDFGLTGGLQSLDADEVRTWLDHVDVGNAYVNRGITGAIVQRQSFGGWKKSSVGLGSKAGGPNYVMLMGTWADAPSHHAPRETNPLISKLDLPGEELEWLEKANASDETAWNTEFGSPRDPSGLDVEANIFRYRPAEVVLRLDDSATPRETARALLAARRAGVTPRVLQTPGVSEQVREVLSAAGVSAETVDDSVFISNVLRGEYDENSSVRVRYLGKVSDTVRERLSVRPEVVLLDDAVTASGRVELRYWLKEQAISMTLHRFGNPVAAFHELAEELKR

SEQ ID NO: 67 - DNA, 1362 bp, Corynebacterium glutamicum
  CDS (1)..(1362)
gtgtctttgaccttcccagtaatcaaccccagcgatggctccaccatcaccgagctagaaaaccacgattccacccagtggatgtccgcgctctctgatgcagttgcagctggtccttcatgggctgcgaaaactccccgcgaaagatccgtggtactcaccgcaatcttcgaagcactgaccgaacgcgcccaagaacttgcagagatcatccacctggaagctggaaaatccgttgcagaagctcttggtgaagtcgcttatggtgcagaatacttccgttggtttgcggaagaagcagtgcgcctgcccggccgctacggacagtcaccttccggaatcggtcacatcgccgtcacccgcgcacccgtgggaccagtgctggcgatcaccccatggaatttccccatcgccatggccacccgcaaaatcgccccagccctggccgctggttgccccgtgttggtgaaacctgcttccgaaaccccactgaccatggtcaaagtgggggagatcatcgcctccgtctttgatacctttaatatcccgcagggcttggtctcaatcatcaccaccactcgagatgcagagctatcggcagaactcatggctgatcctcgcttggctaaagtcaccttcactggatcaaccaacgtgggacgcatcctggtccgccaatccgcggaccgactgctgcgcacctccatggaactcggcggaaatgcagcttttgttatcgacgaagccgcagacctcgacgaagccgtatccggtgccatcgccgcaaaactccgcaacgccggccaagtatgcatcgcagctaaccgtttcttggttcatgaatcccgcgctgccgaattcacctcaaagctggcgacagccatgcagaacactcccattgggccggtgatttctgcccgccaacgcgaccggatcgcagcactagtggatgaagccatcaccgacggcgcccgcctcatcatcggtggggaggtccccgacggctccggcttcttctatccagccaccatcttggccgatgtccctgcacagtcacggattgtgcatgaggaaatcttcggacctgtggccaccattgccactttcaccgacttggccgaaggcgttgcacaagcaaattccaccgaattcggcctcgcagcctacggattcagcaacaatgtgaaagcaacacagtacatggcggaacacttggaagccggaatggtcggaatcaacagaggcgccatctctgacccagcagcaccttttggcggcatcggacaatccggcttcggcagagaaggcggaaccgaaggaatcgaagaatatctctccgtgcgttacctcgctttgccgtga

SEQ ID NO: 68 - protein, 453 aa, Corynebacterium glutamicum
VSLTFPVINPSDGSTITELENHDSTQWMSALSDAVAAGPSWAAKTPRERSVVLTAIFEALTERAQELAEIIHLEAGKSVAEALGEVAYGAEYFRWFAEEAVRLPGRYGQSPSGIGHIAVTRAPVGPVLAITPWNFPIAMATRKIAPALAAGCPVLVKPASETPLTMVKVGEIIASVFDTFNIPQGLVSIITTTRDAELSAELMADPRLAKVTFTGSTNVGRILVRQSADRLLRTSMELGGNAAFVIDEAADLDEAVSGAIAAKLRNAGQVCIAANRFLVHESRAAEFTSKLATAMQNTPIGPVISARQRDRIAALVDEAITDGARLIIGGEVPDGSGFFYPATILADVPAQSRIVHEEIFGPVATIATFTDLAEGVAQANSTEFGLAAYGFSNNVKATQYMAEHLEAGMVGINRGAISDPAAPFGGIGQSGFGREGGTEGIEEYLSVRYLALP

SEQ ID NO: 69 - DNA, 1521 bp, Corynebacterium glutamicum
  CDS (1)..(1521)
atgactgtctacgcaaatccaggaaccgaaggctcgatcgttaactatgaaaagcgctacgagaactacattggtggcaagtgggttccaccggtagagggccagtaccttgagaacatttcacctgtcactggtgaagttttctgtgaggtcgcacgtggcaccgcagcggacgtggagcttgcactggatgctgcacatgcagccgctgatgcgtggggcaagacttctgtcgctgaacgtgctctgatcctgcaccgcattgcggaccgcatggaagagcacctggaagaaatcgcagttgcagaaacctgggagaacggcaaggcagtccgtgagactcttgctgcagatatcccactggcaatcgaccacttccgctactttgctggcgcgatccgtgctcaggaagatcgttcctcacagatcgaccacaacactgttgcttaccacttcaacgagccaatcggtgttgttggtcagatcattccttggaacttcccaatcctcatggctacctggaagctcgcaccggcacttgctgcaggtaacgcgatcgtcatgaagccagctgagcagaccccagcatccattttgtatctgattaacatcatcggcgatctcatcccagagggcgtcctcaacatcgtcaacggactcggcggtgaagcaggcgctgcactgtccggctctaatcggattggcaagattgctttcaccggttccaccgaggtcggcaagctgatcaaccgcgctgcatccgacaagatcattcctgtcaccctggagctcggcggtaagtccccatccatcttcttctccgatgttctgtcacaggatgacgccttcgcagagaaggcagttgaaggcttcgcgatgttcgccctcaatcagggtgaagtttgtacctgtccttcccgtgcacttgttcatgagtccatcgctgatgaattcctcgagcttggcgtgaagcgagttcagaacatcaagctgggtaacccacttgatactgaaaccatgatgggtgctcaggcgtcccaggagcagatggacaagatctcctcctacctgaagatcggcccagaagaaggcgctcaaaccctcactggtggcaaggtcaacaaggttgatggcatggagaacggttactacattgagccaaccgttttccgcggcaccaacgacatgaggatcttccgcgaggaaatcttcggaccagtcctttctgttgctaccttcagcgacttcgatgaggccatccgtattgcaaacgacaccaactacggcctcggcgctggtgtctggagccgtgaccaaaacaccatttatcgtgcaggtcgcgcaatccaggctggtcgagtttgggtcaaccagtaccacaactacccagcgcactccgctttcggtggatacaaggagtccggcatcggccgtgagaaccacctcatgatgctgaaccactaccagcagaccaagaacctgttggtctcctacgatccaaacccaaccggactgttctga

SEQ ID NO: 70 - protein, 506 aa, Corynebacterium glutamicum
MTVYANPGTEGSIVNYEKRYENYIGGKWVPPVEGQYLENISPVTGEVFCEVARGTAADVELALDAAHAAADAWGKTSVAERALILHRIADRMEEHLEEIAVAETWENGKAVRETLAADIPLAIDHFRYFAGAIRAQEDRSSQIDHNTVAYHFNEPIGVVGQIIPWNFPILMATWKLAPALAAGNAIVMKPAEQTPASILYLINIIGDLIPEGVLNIVNGLGGEAGAALSGSNRIGKIAFTGSTEVGKLINRAASDKIIPVTLELGGKSPSIFFSDVLSQDDAFAEKAVEGFAMFALNQGEVCTCPSRALVHESIADEFLELGVKRVQNIKLGNPLDTETMMGAQASQEQMDKISSYLKIGPEEGAQTLTGGKVNKVDGMENGYYIEPTVFRGTNDMRIFREEIFGPVLSVATFSDFDEAIRIANDTNYGLGAGVWSRDQNTIYRAGRAIQAGRVWVNQYHNYPAHSAFGGYKESGIGRENHLMMLNHYQQTKNLLVSYDPNPTGLF

SEQ ID NO: 71 - DNA, 1473 bp, Corynebacterium glutamicum
  CDS (1)..(1473)
atgactattaatgtctccgaactacttgccaaagtccccacgggtctactgattggtgattcctgggtggaagcatccgacggcggtactttcgatgtggaaaacccagcgacgggtgaaacaatcgcaacgctcgcgtctgctacttccgaggatgcactggctgctcttgatgctgcatgcgctgttcaggccgagtgggctaggatgccagcgcgcgagcgttctaatattttacgccgcggttttgagctcgtagcagaacgtgcagaagagttcgccaccctcatgaccttggaaatgggcaagcctttggctgaagctcgcggcgaagtcacctacggcaacgaattcctgcgctggttctctgaggaagcagttcgtctgtatggccgttacggaaccacaccagaaggcaacttgcggatgctgaccgccctcaagccagttggcccgtgcctcctgatcaccccatggaacttcccactagcaatggctacccgcaaggtcgcacctgcgatcgctgcaggttgtgtcatggtgctcaagccagctcgacttaccccgctgacctcccagtattttgctcagaccatgcttgatgccggtcttccagcaggtgtcctcaatgtggtctccggtgcttccgcctctgcgatttccaacccgattatggaagacgatcgccttcgtaaagtctccttcaccggctccaccccagttggccagcagctgctcaaaaaggctgccgataaagttctgcgcacctccatggaacttggtggcaacgcacctttcattgtcttcgaggacgccgacctagatctcgcgatcgaaggtgccatgggtgccaaaatgcgcaacatcggcgaagcttgcaccgcagccaaccgtttcttagtccacgaatccgtcgccgatgaattcggccgtcgcttcgctgcccgccttgaagagcaagtcctaggcaacggcctcgacgaaggcgtcaccgtgggccccctggttgaggaaaaagcacgagacagcgttgcatcgcttgtcgacgccgccgtcgccgaaggtgccaccgtcctcaccggcggcaaggccggcacaggtgcaggctacttctacgaaccaacggtgctcacgggagtttcaacagatgcggctatcctgaacgaagagatcttcggtcccgtcgcaccgatcgtcaccttccaaaccgaggaagaagccctgcgtctagccaactccaccgaatacggactggcctcctatgtgttcacccaggacacctcacgtattttccgcgtctccgatggtctcgagttcggcctagtgggcgtcaattccggtgtcatctctaacgctgctgcaccttttggtggcgtaaaacaatccggaatgggccgcgaaggtggtctcgaaggaatcgaggagtacacctccgtgcagtacatcggtatccgggatccttacgccggctag

SEQ ID NO: 72 - protein, 490 aa, Corynebacterium glutamicum
MTINVSELLAKVPTGLLIGDSWVEASDGGTFDVENPATGETIATLASATSEDALAALDAACAVQAEWARMPARERSNILRRGFELVAERAEEFATLMTLEMGKPLAEARGEVTYGNEFLRWFSEEAVRLYGRYGTTPEGNLRMLTALKPVGPCLLITPWNFPLAMATRKVAPAIAAGCVMVLKPARLTPLTSQYFAQTMLDAGLPAGVLNVVSGASASAISNPIMEDDRLRKVSFTGSTPVGQQLLKKAADKVLRTSMELGGNAPFIVFEDADLDLAIEGAMGAKMRNIGEACTAANRFLVHESVADEFGRRFAARLEEQVLGNGLDEGVTVGPLVEEKARDSVASLVDAAVAEGATVLTGGKAGTGAGYFYEPTVLTGVSTDAAILNEEIFGPVAPIVTFQTEEEALRLANSTEYGLASYVFTQDTSRIFRVSDGLEFGLVGVNSGVISNAAAPFGGVKQSGMGREGGLEGIEEYTSVQYIGIRDPYAG

SEQ ID NO: 73 - DNA, 1455 bp, Corynebacterium glutamicum
  CDS (1)..(1455)
gtgactgcaacatttgctggaatcgacgccaccaaacacctcatcggaggtcagtgggtggagggaaactcggatcgaatttccaccaatatcaatccttacgacgattccgtaatcgccgaaagcaaacaagcttccattgctgatgttgatgccgcgtatgaagccgcgaagaaggcccaggctgagtgggcagctacgcccgctgcggaacgatctgccatcatctaccgtgcggctgaacttcttgaagagcaccgggaggaaatcgtggaatggctgatcaaggaatccggctcgacgcgttccaaggctaatttggaaatcactttggcaggaaacatcactaaagaatcggcttcattccctggtcgtgtgcatggtcgaatttctccttcgaatactccgggcaaagaaaaccgtgtgtaccgcgtagccaagggcgttgtcggagtgattagtccatggaatttcccactgaacctctcgatccgctcggttgctccggcactagccgtgggcaacgccgtagtgattaagcctgcgagtgataccccagttactggtggtgtaattcctgcacgaatctttgaggaggccggagttcctgcaggcgtgatcagcacggttgcgggcgcaggatctgaaatcggtgatcactttgtcacccacgccgtgccaaagctgatttctttcaccggttcaaccccagtcggtcgtcgtgtcggtgagctggcaattaatggtggaccaatgaaaactgttgcactagagctcggtggcaacgcgccgttcgttgtgcttgccgacgccgacatcgacgccgctgcccaggctgccgcagttggcgctttcctacaccagggacagatttgtatgtcaatcaaccgagtcattgttgatgctgcagttcatgatgaattcctagagaagttcgttgaagcagtgaagaacattccaaccggcgatccaagcgcagaaggaacccttgttggacctgtcattaatgacagtcagctcagtggtttgaaggaaaagatcgagttggccaaaaaggaaggcgcaaccgtccaggttgaagggccaattgaaggccgactggttcatccgcatgtgttctctgatgtcacctctgacatggaaatcgctcgtgaggaaatcttcggacctctcatcagcgtgctgaaggccgatgatgaggcacacgcagcagagctggccaatgcttccgactttggtttgagcgcggcagtgtggtcgaaggatattgatcgtgcagcccagtttgctctgcagattgattccggcatggttcacatcaatgacctcaccgtcaacgatgaaccacacgtgatgttcggtggttcaaagaactctggcctcggccgcttcaacggcgattgggcgatcgaggagttcaccacagatcgatggatcggcatcaagcgcagctaa

SEQ ID NO: 74 - protein, 484 aa, Corynebacterium glutamicum
VTATFAGIDATKHLIGGQWVEGNSDRISTNINPYDDSVIAESKQASIADVDAAYEAAKKAQAEWAATPAAERSAIIYRAAELLEEHREEIVEWLIKESGSTRSKANLEITLAGNITKESASFPGRVHGRISPSNTPGKENRVYRVAKGVVGVISPWNFPLNLSIRSVAPALAVGNAVVIKPASDTPVTGGVIPARIFEEAGVPAGVISTVAGAGSEIGDHFVTHAVPKLISFTGSTPVGRRVGELAINGGPMKTVALELGGNAPFVVLADADIDAAAQAAAVGAFLHQGQICMSINRVIVDAAVHDEFLEKFVEAVKNIPTGDPSAEGTLVGPVINDSQLSGLKEKIELAKKEGATVQVEGPIEGRLVHPHVFSDVTSDMEIAREEIFGPLISVLKADDEAHAAELANASDFGLSAAVWSKDIDRAAQFALQIDSGMVHINDLTVNDEPHVMFGGSKNSGLGRFNGDWAIEEFTTDRWIGIKRS

SEQ ID NO: 75 - DNA, 1566 bp, Corynebacterium glutamicum
  CDS (1)..(1566)
atgatcaaacgtcttcctttaggtccgctgcctaaagaacttcatcagactctgcttgatctgaccgcaaatgcccaagatgcggcgaaagtggaggttatagcgccatttactggcgagaccctcggatttgtttttgatggtgatgagcaagacgtcgagcatgcttttgcactttcaagggcagcccagaaaaagtgggtgcacaccacggcagtggaacggaagaagatcttcctgaagtttcatgatctggtattgaaaaaccgtgagctgctcatggacatcgtgcagttggaaacaggcaaaaatcgagcatcggctgccgatgaggtgttggacgttgcgatcaccacccgcttctacgcaaacaatgcaggaaagtttttaaatgacaagaaacgccccggcgcgcttccgatcatcacgaaaaacacacaacagtatgtgcccaagggagtggtcgggcagatcacgccgtggaattaccctttaactttgggagtatctgatgctgttccggcgctgctggcaggaaacgcagtggtggctaaacctgacctcgcgacacctttctcctgcttgatcatggtgcacctgctcattgaagccggtctgccgcgtgatttgatgcaggttgtcaccggccctggcgatattgttggcggtgcgattgcagctcagtgtgatttcctcatgttcactggatccacggccacgggccggatcttgggtcggacaatgggtgagcgtttggtgggtttctctgcggaattaggcggaaagaaccctcttattgtggccaaggatgcagatctggacaaggtggaagctgagcttccgcaggcgtgtttttccaactcggggcaattgtgtgtctccactgaacgtatttatgtcgaggaagacgtgtacgaggaggtgattgcacggtttagcaaggcggcgaaagccatgtccattggtgccggatttgagtggaaatatgagatgggttcgttgatcaatcaggcgcagctggatcgggtgagcacctttgttgatcaggctaaagctgcgggcgccacggtgctgtgcggtggcaagtcacgccctgatattggtcccttcttctatgagcccacggtattggcggatgtcccagagggcaccccactgctcacggaggaagtcttcgggccggtggtgttcatcgaaaaggtagccacactggaagaagccgtcgataaggcaaatggcacgccctacggcctgaatgcgtccgtctttgggtcgtcggaaaccggcaatcttgttgcaggccagctggaagctggcggtatcggtattaatgatggctacgccgcgacgtgggcgagcgtgtccacgcctctgggtggcatgaagcagtcggggctggggcaccgccatggtgcggagggaattacaaaatatgcggagatccgaaacatcgcggagcagcgctggatgtctatgcgtgggccggccaaaatgccgcgaaaggtgtactcagacaccgtggccacagcgctaaagctgggcaaaatctttaaagttttgccgtag

SEQ ID NO: 76 - protein, 521 aa, Corynebacterium glutamicum
MIKRLPLGPLPKELHQTLLDLTANAQDAAKVEVIAPFTGETLGFVFDGDEQDVEHAFALSRAAQKKWVHTTAVERKKIFLKFHDLVLKNRELLMDIVQLETGKNRASAADEVLDVAITTRFYANNAGKFLNDKKRPGALPIITKNTQQYVPKGVVGQITPWNYPLTLGVSDAVPALLAGNAVVAKPDLATPFSCLIMVHLLIEAGLPRDLMQVVTGPGDIVGGAIAAQCDFLMFTGSTATGRILGRTMGERLVGFSAELGGKNPLIVAKDADLDKVEAELPQACFSNSGQLCVSTERIYVEEDVYEEVIARFSKAAKAMSIGAGFEWKYEMGSLINQAQLDRVSTFVDQAKAAGATVLCGGKSRPDIGPFFYEPTVLADVPEGTPLLTEEVFGPVVFIEKVATLEEAVDKANGTPYGLNASVFGSSETGNLVAGQLEAGGIGINDGYAATWASVSTPLGGMKQSGLGHRHGAEGITKYAEIRNIAEQRWMSMRGPAKMPRKVYSDTVATALKLGKIFKVLP

SEQ ID NO: 77 - DNA, 1374 bp, Lactobacillus reuteri
  CDS (1)..(1374)
atggcatatcaaagtatcaatccatttacgaaccaagtagaaaaaacgtttgaaaatacaactgatgaagaattagaacaaacattaactacggcgcatcaattatatttagattggcggaagtataatgaccttgaagaacggaaacggcaaattttaaagttaggtcaaatattacgtgaacggcgtgttgaatatgcgacagttatgagtaaggaaatgggaaaattaattagcgaagcagaaggcgaggttgacctttgtgcttctttctgtgattattatgcagcccatgcagatgaatttctgcaaccaaaaattattgcgacaacgagtggacgcgccaaagttttgaagcaatcattaggaattttagttgcagttgaaccttggaatttcccattctatcaaattgcccgggtatttattcccaactttattgcaggaaaccccatgatcttgaaggatgcgtcgaattgtccagcatccgcccaagcatttaacgatgccgttaaggaagctggtgcgccagccggcagtttaactaatttattcctttcatatgaccaagtaaataaggcaattgctgataagcgggtagccggcgtttgtcttactggttctgaacgtggtggtgcaaccgttgctaaagaggctggtgctaatttgaagaagagcactttggaacttggtggtaatgatgcctttattatcttagacgatgcagattgggatcttgtcgaaaaagttgccccggcagcccgtctgtataatgctggacaagtatgtacatcatcaaaacgttttattgtccttgaaaaggattatgatcgtttcttaaagatgatgaaagatgcgttctcgaaagttaaaatgggtgatccccttgatccattaacaactctggcaccattatcatctaagaaagcaaaagaaaagctccaacagcaagtcgcaacagcagtagaaaatggggccaaagtttactatggtaataagccggttgacatggaaggtcaattctttatgccaacgatcttaactgatatcactccagataacccaatatttgatacggaaatgtttgggccagtggcttcggtttataaggttagttccgaagaggaagcaatcgaactggctaataattcaagctatgggttaggaaacactatctttagcaatgattccgaacatgcggaacgagtagcagcgaagatcgaaactggaatgagttggattaatgccggctgggcttcattaccagaattaccatttggtggtgttaagaattcaggttacggtcgtgaactcagcagttacggaattgatgaatttactaacaaacatctaatttacgaagcacgacaataa

SEQ ID NO: 78 - protein, 457 aa, Lactobacillus reuteri
MAYQSINPFTNQVEKTFENTTDEELEQTLTTAHQLYLDWRKYNDLEERKRQILKLGQILRERRVEYATVMSKEMGKLISEAEGEVDLCASFCDYYAAHADEFLQPKIIATTSGRAKVLKQSLGILVAVEPWNFPFYQIARVFIPNFIAGNPMILKDASNCPASAQAFNDAVKEAGAPAGSLTNLFLSYDQVNKAIADKRVAGVCLTGSERGGATVAKEAGANLKKSTLELGGNDAFIILDDADWDLVEKVAPAARLYNAGQVCTSSKRFIVLEKDYDRFLKMMKDAFSKVKMGDPLDPLTTLAPLSSKKAKEKLQQQVATAVENGAKVYYGNKPVDMEGQFFMPTILTDITPDNPIFDTEMFGPVASVYKVSSEEEAIELANNSSYGLGNTIFSNDSEHAERVAAKIETGMSWINAGWASLPELPFGGVKNSGYGRELSSYGIDEFTNKHLIYEARQ

SEQ ID NO: 79 - DNA, 1563 bp, Saccharomyces cerevisiae
  CDS (1)..(1563)
atgctttctcgcacaagagctgcagctccgaattccagaatattcactagaagcttgttacgtctttattctcaagcaccattacgcgttccaattactcttccaaatggtttcacctacgaacagccaacagggttattcatcaatggtgaatttgttgcctcgaagcaaaagaaaacgtttgacgtgatcaatccatctaacgaagaaaagataacaactgtatacaaggctatggaagatgatgttgatgaagccgttgcagcggctaaaaaagcttttgaaacgaagtggtctattgtagagccggaggttcgcgctaaagctttattcaatctcgctgacttggttgagaaacaccaagaaacactggctgccattgagtcaatggataatggtaagtcattgttttgtgcgcgcggtgacgtcgctttagtatctaaatacttgcgttcttgcggtggttgggcagataaaatctacggtaacgttattgacacaggtaaaaaccattttacctactcaattaaggaaccattaggcgtttgcggccaaataatcccttggaacttccctttattgatgtggtcatggaaaattgggcctgctctggctacaggtaacaccgtcgtattgaaacccgctgaaacaacacctttatctgcccttttcgcttcccagttgtgtcaggaagcaggcatacccgctggtgtagtcaatatccttccgggttccggtagagttgttggagaaagattgagtgcacacccagacgtgaagaagattgcttttacaggctctactgccaccggccgccatattatgaaggtcgctgccgatactgtcaagaaagtcactttggagctgggaggtaaatcaccaaatattgtgtttgctgacgctgatctagataaagccgtcaagaacattgccttcggtattttttacaactctggtgaagtttgctgcgctggttccagaatatacattcaagatacagtatacgaggaggtgttgcaaaaactaaaggattacaccgagtcactaaaggtcggtgacccatttgatgaggaagttttccaaggtgctcaaacatctgacaaacagctgcataaaattttagactatgtcgatgtagcaaaatcagagggggctcgtcttgtgactggaggggccagacatggcagtaaaggttattttgtcaagccaacagtgtttgctgatgtcaaagaagatatgagaattgttaaggaggaagtgtttggtcccattgtaactgtatccaagttttctactgttgatgaagtgattgctatggcaaatgattctcaatatgggttagccgcaggtattcacactaacgatattaacaaggctgttgatgtgtccaaaagagtgaaagctggtactgtttggataaatacctataacaacttccaccaaaatgttcctttcggtggcttcggccagtcaggtattggccgtgaaatgggtgaggctgctttaagtaactacactcaaacaaaatctgtcagaattgccattgacaagccaattcgttga

SEQ ID NO: 80 - protein, 520 aa, Saccharomyces cerevisiae
MLSRTRAAAPNSRIFTRSLLRLYSQAPLRVPITLPNGFTYEQPTGLFINGEFVASKQKKTFDVINPSNEEKITTVYKAMEDDVDEAVAAAKKAFETKWSIVEPEVRAKALFNLADLVEKHQETLAAIESMDNGKSLFCARGDVALVSKYLRSCGGWADKIYGNVIDTGKNHFTYSIKEPLGVCGQIIPWNFPLLMWSWKIGPALATGNTVVLKPAETTPLSALFASQLCQEAGIPAGVVNILPGSGRVVGERLSAHPDVKKIAFTGSTATGRHIMKVAADTVKKVTLELGGKSPNIVFADADLDKAVKNIAFGIFYNSGEVCCAGSRIYIQDTVYEEVLQKLKDYTESLKVGDPFDEEVFQGAQTSDKQLHKILDYVDVAKSEGARLVTGGARHGSKGYFVKPTVFADVKEDMRIVKEEVFGPIVTVSKFSTVDEVIAMANDSQYGLAAGIHTNDINKAVDVSKRVKAGTVWINTYNNFHQNVPFGGFGQSGIGREMGEAALSNYTQTKSVRIAIDKPIR

SEQ ID NO: 81 - DNA, 1728 bp, Saccharomyces cerevisiae
  CDS (1)..(1728)
atgctatcagcaaggtgcctcaaatctatatacttcaagagatctttctcacaactgggacacatcaagccccccaagcacataagaaatgaacctgttaagccatttagaaacatagacttaaaagactgggacttactgagggcttccttgatgaaattcaaaagttcttctttagaagtgccactggtcatcaatggggaaaggatatatgacaataatgaaagagcgcttttcccgcagactaaccctgcgaaccatcaacaagtactggcaaacgtcacacaagccacggaaaaagatgtcatgaatgctgtaaaagccgccaaggatgccaaaaaggattggtacaatctaccgttttatgacagatctgcaatttttttgaaagccgctgacttaatttccaccaagtatcgttatgacatgttagctgctacaatgctgggccagggaaaaaatgtgtatcaggcagaaatcgactgtatcacggaattatctgacttttttagatactatgtcaagtatgcatcagacttgtatgctcaacaacccgtagagtcagcggatggtacttggaataaagctgaatacagacctttagagggatttgtgtatgctgtttcaccattcaactttactgctattgctgcaaacttgattggggctccagctttgatgggtaatacagttgtctggaaaccttcacaaaccgctgccctttcaaattacttattgatgactgttttggaagaagcgggattgccaaagggtgtcataaatttcattccaggtgatccagttcaagttactgaccaggtattagctgataaagattttggtgccttgcattttaccggttctacaaatgtctttaagagtttgtatggcaaaatacaaagtggcgttgttgaagggaagtacagagattacccccgtattattggtgagacaggtggtaaaaatttccatctagttcacccaagtgcaaatatatcacatgcagtactctctactattagaggcactttcgagttccaaggccaaaagtgctctgccgcttccaggttatatcttccagagtcaaaaagtgaagaattcttatccgatatgtttggcatattgcagtcacagaatgttgtcccaatgaacacatccgcaagtccaatttctggtgggaatttgcggggatttatgggtcctgtcatccatgaacaaagtttcgacaaattagttaaagtaattgaagatgcaaagaaagaccccgagttggaaattctttacggtggacaatacgataaaagccaaggttggtttgtcggacccacagtcataaaagccaagagaccagatcatccatatatgtcaacagaattttttggccctatattaactgtttacgagtatccagatactgaatttaatgaaatctgtgatattatcgataatacgagtcaatacgccttaactggtgctatttttgccaaagatcgtaaagcaattgaatacgcagatgagaagttgaagtttagcgcaggaaatttctacataaatgataagtgtactggtgccgttgtttctcagcaatggtttggtggcgcaagaatgagtggtaccgacgataaggctggtggtccaaacattttaagcagatttgtcagtattagaaacacaaaggagaacttctacgagttgactgatttcaaatatccatcgaattatgaataa

SEQ ID NO: 82 - protein, 575 aa, Saccharomyces cerevisiae
MLSARCLKSIYFKRSFSQLGHIKPPKHIRNEPVKPFRNIDLKDWDLLRASLMKFKSSSLEVPLVINGERIYDNNERALFPQTNPANHQQVLANVTQATEKDVMNAVKAAKDAKKDWYNLPFYDRSAIFLKAADLISTKYRYDMLAATMLGQGKNVYQAEIDCITELSDFFRYYVKYASDLYAQQPVESADGTWNKAEYRPLEGFVYAVSPFNFTAIAANLIGAPALMGNTVVWKPSQTAALSNYLLMTVLEEAGLPKGVINFIPGDPVQVTDQVLADKDFGALHFTGSTNVFKSLYGKIQSGVVEGKYRDYPRIIGETGGKNFHLVHPSANISHAVLSTIRGTFEFQGQKCSAASRLYLPESKSEEFLSDMFGILQSQNVVPMNTSASPISGGNLRGFMGPVIHEQSFDKLVKVIEDAKKDPELEILYGGQYDKSQGWFVGPTVIKAKRPDHPYMSTEFFGPILTVYEYPDTEFNEICDIIDNTSQYALTGAIFAKDRKAIEYADEKLKFSAGNFYINDKCTGAVVSQQWFGGARMSGTDDKAGGPNILSRFVSIRNTKENFYELTDFKYPSNYE

SEQ ID NO: 83 - DNA, 1935 bp, Saccharomyces cerevisiae
  CDS (1)..(1935)
atgtccaaggtctatctgaattcagacatgattaaccatttgaactccacagttcaagcttactttaacttatggttggagaagcaaaacgcaataatgcgttctcaaccccaaattattcaagataaccaaaaactgataggcattacaacgctagttgcctcaattttcactctgtatgttttggtcaagataatctccaccccagcaaagtgttcctcgtcctataagccagtcaaattctcccttcctgcaccagaggccgctcaaaataattggaagggcaagaggtctgtttccactaacatatggaatcctgaagaaccaaactttattcaatgtcattgtcccgccacaggtcaatatctaggttcttttccatcgaaaacggaagctgacatagatgaaatggtttctaaggcaggcaaagctcaatctacttggggcaattctgatttctcaagaagattgagagttttggcttctttgcatgattatattctaaataatcaagatcttattgcgagagtagcgtgcagggattcaggaaagacaatgttagacgcatcgatgggtgaaatcttggttactttagaaaaaattcaatggactataaagcacggccaaagagcgttgcaaccttcgagacgtccgggccccactaattttttcatgaagtggtataaaggtgcagaaatccgttatgaaccactgggtgtgatcagttctatcgtttcctggaactatccattccataacttattgggtccaattattgcagcattgttcacagggaatgccattgtagtaaaatgttcagaacaagttgtctggtcttcggaatttttcgtcgagctgatccgcaaatgtttggaagcttgtgatgaagatccagatttggttcagttgtgctattgtttacctccaactgaaaatgatgattccgcaaattatttcacctctcatcctggtttcaaacatatcacttttattggcagtcagcccgtagcgcactatattctaaaatgcgctgccaaatcattgacacccgtagttgtggagcttggtggtaaggatgcgtttattgtcctagactcagctaagaatttagatgctttatcttctatcatcatgaggggtactttccaatcatccggtcaaaattgtattggtattgagagggttattgtcagtaaggaaaattatgatgatttagtcaagattttgaatgaccgtatgactgcaaatccactacgccaagggtctgatattgatcatttagaaaatgttgatatgggggcaatgatatctgacaacagattcgatgaactagaagctttggttaaagatgctgttgcaaagggagctcgtttacttcaaggtggttcccgcttcaaacatccaaagtatccacaaggtcattatttccaaccaactcttttggtggatgtcactccagaaatgaaaatagcacaaaacgaagtgtttggcccaattttagtcatgatgaaagctaagaatactgaccattgtgtacaactagccaactctgcgccatttggtctaggtggttctgtgtttggtgcggatatcaaggaatgcaattacgtcgcaaatagcctacaaactggtaatgtagccattaatgattttgctacattctatgtttgtcaattaccatttggtggtatcaatggttcaggttacggtaaatttggtggtgaagaaggtcttttgggtttgtgcaatgccaaaagtgtctgttttgatactttgccttttgtctccactcaaattccaaaaccattagactaccctattcgtaacaatgctaaggcttggaattttgtaaagagtttcatcgtaggagcttatacaaattccacatggcaaagaataaagtcactgttctctttagctaaagaagccagctag

SEQ ID NO: 84 - protein, 644 aa, Saccharomyces cerevisiae
MSKVYLNSDMINHLNSTVQAYFNLWLEKQNAIMRSQPQIIQDNQKLIGITTLVASIFTLYVLVKIISTPAKCSSSYKPVKFSLPAPEAAQNNWKGKRSVSTNIWNPEEPNFIQCHCPATGQYLGSFPSKTEADIDEMVSKAGKAQSTWGNSDFSRRLRVLASLHDYILNNQDLIARVACRDSGKTMLDASMGEILVTLEKIQWTIKHGQRALQPSRRPGPTNFFMKWYKGAEIRYEPLGVISSIVSWNYPFHNLLGPIIAALFTGNAIVVKCSEQVVWSSEFFVELIRKCLEACDEDPDLVQLCYCLPPTENDDSANYFTSHPGFKHITFIGSQPVAHYILKCAAKSLTPVVVELGGKDAFIVLDSAKNLDALSSIIMRGTFQSSGQNCIGIERVIVSKENYDDLVKILNDRMTANPLRQGSDIDHLENVDMGAMISDNRFDELEALVKDAVAKGARLLQGGSRFKHPKYPQGHYFQPTLLVDVTPEMKIAQNEVFGPILVMMKAKNTDHCVQLANSAPFGLGGSVFGADIKECNYVANSLQTGNVAINDFATFYVCQLPFGGINGSGYGKFGGEEGLLGLCNAKSVCFDTLPFVSTQIPKPLDYPIRNNAKAWNFVKSFIVGAYTNSTWQRIKSLFSLAKEAS

SEQ ID NO: 85 - DNA, 1521 bp, Saccharomyces cerevisiae
  CDS (1)..(1521)
atgcctaccttgtatactgatatcgaaatcccacaattgaaaatctctttaaagcaaccgctagggttgtttatcaacaatgagttttgtccatcatcagatggaaagaccatcgaaactgtgaacccagctactggcgaaccgataacatccttccaagcagctaacgaaaaggatgtagacaaagctgtgaaagctgccagggctgcttttgataacgtttggtcgaagacatcttctgagcaacgtggtatttatctttcaaacttattaaaacttattgaggaggagcaagacacacttgccgcattagagactttagacgctggtaagcctttccattccaatgctaaacaagacttagcccagattatagaacttacaagatactatgcgggggcggtcgacaagttcaatatgggtgaaaccattccattgacttttaacaagtttgcatatactctaaaagttccttttggcgttgttgctcaaatcgttccatggaattatcctctagctatggcttgtagaaaaatgcaaggtgccttagcggccggtaacacggttatcatcaaacctgctgaaaatacctctctatctctactttattttgctactttaattaaaaaagcaggttttccacctggtgttgtcaatgtcattcctggttatggttccgttgtggggaaagctttaggaacccacatggatatcgacaaaatatcttttacgggaagtactaaggttggcggctcagtattggaagcttccggccaatcgaaccttaaggatatcacactagaatgcggtggtaagtctcctgctcttgtatttgaagatgcagaccttgataaggctatagaatgggtagcaaatggtattttttttaattcgggacagatctgcactgcaaactcaagagtttatgttcaaagttcgatctacgacaagtttgttgaaaagtttaaagaaactgcaaagaaggagtgggatgttgcaggaaaatttgatccgtttgatgagaaatgcatcgttggtccagttatatcaagtacacagtatgaccgcatcaaaagttacatagaacgtggtaaaaaggaggaaaagttggacatgttccagacctctgaatttcctattggtggagctaaaggctacttcattcccccaaccatcttcactgatgtaccagaaacatctaagttgctgcgtgatgaaatatttggcccggttgtggttgttagcaagttcacaaattatgatgacgctctgaagctggctaatgatacttgctacgggctcgcctctgcggtcttcaccaaagatgtcaagaaagcgcacatgtttgctcgcgatattaaagcaggaactgtttggatcaatcaaaccaatcaagaagaagctaaagttccttttggcggatttaagatgagtggtattggtagagaatcaggcgacaccggcgttgataactatttacaaataaaatcagtccatgtggatctttcattggataaataa

SEQ ID NO: 86 - protein, 506 aa, Saccharomyces cerevisiae
MPTLYTDIEIPQLKISLKQPLGLFINNEFCPSSDGKTIETVNPATGEPITSFQAANEKDVDKAVKAARAAFDNVWSKTSSEQRGIYLSNLLKLIEEEQDTLAALETLDAGKPFHSNAKQDLAQIIELTRYYAGAVDKFNMGETIPLTFNKFAYTLKVPFGVVAQIVPWNYPLAMACRKMQGALAAGNTVIIKPAENTSLSLLYFATLIKKAGFPPGVVNVIPGYGSVVGKALGTHMDIDKISFTGSTKVGGSVLEASGQSNLKDITLECGGKSPALVFEDADLDKAIEWVANGIFFNSGQICTANSRVYVQSSIYDKFVEKFKETAKKEWDVAGKFDPFDEKCIVGPVISSTQYDRIKSYIERGKKEEKLDMFQTSEFPIGGAKGYFIPPTIFTDVPETSKLLRDEIFGPVVVVSKFTNYDDALKLANDTCYGLASAVFTKDVKKAHMFARDIKAGTVWINQTNQEEAKVPFGGFKMSGIGRESGDTGVDNYLQIKSVHVDLSLDK

SEQ ID NO: 87 - DNA, 1521 bp, Saccharomyces cerevisiae
  CDS (1)..(1521)
atgcctaccttgtatactgatatcgaaatcccacaattgaaaatctctttaaagcaaccgctagggttgtttatcaacaatgagttttgtccatcatcagatggaaagaccatcgaaactgtgaacccagctactggcgaaccgataacatccttccaagcagctaacgaaaaggatgtagacaaagctgtgaaagctgccagggctgcttttgataacgtttggtcgaagacatcttctgagcaacgtggtatttatctttcaaacttattaaaacttattgaggaggagcaagacacacttgccgcattagagactttagacgctggaaagccttaccattcaaatgccaaaggtgatttggcacaaattttacagcttaccagatattttgctgggtccgctgataagtttgacaaaggtgcaaccataccattgacttttaacaagtttgcatatactctaaaagttccttttggcgttgttgctcaaatcgttccatggaattatcctctagctatggcttgttggaaattgcaaggtgccttagcagccggtaacacggttatcatcaaacctgctgagaatacctctctatctctactttattttgctactttaattaaaaaagcaggttttccacctggtgttgtcaatatcgttcctggttatggatcacttgtaggccaagccctagcatctcacatggatatcgacaaaatatcttttacgggaagcaccaaggtcggtggatttgtgttggaagcttccggccaatcgaaccttaaagacgttacactagaatgcggtggtaagtctcctgctctcgtatttgaagatgcagaccttgataaggctatcgattggatagcagctggcattttctacaattcaggacagaattgtaccgcaaactcaagagtttatgttcaaagttcgatctacgacaagtttgttgaaaagtttaaagaaactgcaaagaaggagtgggatgttgcaggaaaatttgatccgtttgatgagaaatgcatcgttggtccagttatatcaagtacacagtatgaccgcatcaaaagttacatagaacgtggtaaaagggaggaaaagttggacatgttccagacctctgaatttcctattggtggagctaaaggctacttcattcccccaaccatcttcactgatgtcccgcaaacatcgaaactgttacaggatgagatatttggcccggttgtggttgttagcaagttcacaaattatgatgacgctctgaagctggctaatgatacttgctacgggctcgcctctgcggtcttcacaaaagatgtcaagaaagcgcacatgtttgctcgcgatattaaagcaggaactgtttggatcaactcatctaacgatgaagatgttaccgttccttttggcgggtttaaaatgagtggtattggtagagaactggggcaaagtggtgttgatacctatcttcaaacaaaagcagttcacataaatctctctttggacaactaa

SEQ ID NO: 88 - protein, 506 aa, Saccharomyces cerevisiae
MPTLYTDIEIPQLKISLKQPLGLFINNEFCPSSDGKTIETVNPATGEPITSFQAANEKDVDKAVKAARAAFDNVWSKTSSEQRGIYLSNLLKLIEEEQDTLAALETLDAGKPYHSNAKGDLAQILQLTRYFAGSADKFDKGATIPLTFNKFAYTLKVPFGVVAQIVPWNYPLAMACWKLQGALAAGNTVIIKPAENTSLSLLYFATLIKKAGFPPGVVNIVPGYGSLVGQALASHMDIDKISFTGSTKVGGFVLEASGQSNLKDVTLECGGKSPALVFEDADLDKAIDWIAAGIFYNSGQNCTANSRVYVQSSIYDKFVEKFKETAKKEWDVAGKFDPFDEKCIVGPVISSTQYDRIKSYIERGKREEKLDMFQTSEFPIGGAKGYFIPPTIFTDVPQTSKLLQDEIFGPVVVVSKFTNYDDALKLANDTCYGLASAVFTKDVKKAHMFARDIKAGTVWINSSNDEDVTVPFGGFKMSGIGRELGQSGVDTYLQTKAVHINLSLDN

SEQ ID NO: 89 - DNA, 1560 bp, Saccharomyces cerevisiae
  CDS (1)..(1560)
atgttcagtagatctacgctctgcttaaagacgtctgcatcctccattgggagacttcaattgagatatttctcacaccttcctatgacagtgcctatcaagctgcccaatgggttggaatatgagcaaccaacggggttgttcatcaacaacaagtttgttccttctaaacagaacaagaccttcgaagtcattaacccttccacggaagaagaaatatgtcatatttatgaaggtagagaggacgatgtggaagaggccgtgcaggccgccgaccgtgccttctctaatgggtcttggaacggtatcgaccctattgacaggggtaaggctttgtacaggttagccgaattaattgaacaggacaaggatgtcattgcttccatcgagactttggataacggtaaagctatctcttcctcgagaggagatgttgatttagtcatcaactatttgaaatcttctgctggctttgctgataaaattgatggtagaatgattgatactggtagaacccatttttcttacactaagagacagcctttgggtgtttgtgggcagattattccttggaatttcccactgttgatgtgggcctggaagattgcccctgctttggtcaccggtaacaccgtcgtgttgaagactgccgaatccaccccattgtccgctttgtatgtgtctaaatacatcccacaggcgggtattccacctggtgtgatcaacattgtatccgggtttggtaagattgtgggtgaggccattacaaaccatccaaaaatcaaaaaggttgccttcacagggtccacggctacgggtagacacatttaccagtccgcagccgcaggcttgaaaaaagtgactttggagctgggtggtaaatcaccaaacattgtcttcgcggacgccgagttgaaaaaagccgtgcaaaacattatccttggtatctactacaattctggtgaggtctgttgtgcgggttcaagggtgtatgttgaagaatctatttacgacaaattcattgaagagttcaaagccgcttctgaatccatcaaggtgggcgacccattcgatgaatctactttccaaggtgcacaaacctctcaaatgcaactaaacaaaatcttgaaatacgttgacattggtaagaatgaaggtgctactttgattaccggtggtgaaagattaggtagcaagggttacttcattaagccaactgtctttggtgacgttaaggaagacatgagaattgtcaaagaggaaatctttggccctgttgtcactgtaaccaaattcaaatctgccgacgaagtcattaacatggcgaacgattctgaatacgggttggctgctggtattcacacctctaatattaataccgccttaaaagtggctgatagagttaatgcgggtacggtctggataaacacttataacgatttccaccacgcagttcctttcggtgggttcaatgcatctggtttgggcagggaaatgtctgttgatgctttacaaaactacttgcaagttaaagcggtccgtgccaaattggacgagtaa

SEQ ID NO: 90 - protein, 519 aa, Saccharomyces cerevisiae
MFSRSTLCLKTSASSIGRLQLRYFSHLPMTVPIKLPNGLEYEQPTGLFINNKFVPSKQNKTFEVINPSTEEEICHIYEGREDDVEEAVQAADRAFSNGSWNGIDPIDRGKALYRLAELIEQDKDVIASIETLDNGKAISSSRGDVDLVINYLKSSAGFADKIDGRMIDTGRTHFSYTKRQPLGVCGQIIPWNFPLLMWAWKIAPALVTGNTVVLKTAESTPLSALYVSKYIPQAGIPPGVINIVSGFGKIVGEAITNHPKIKKVAFTGSTATGRHIYQSAAAGLKKVTLELGGKSPNIVFADAELKKAVQNIILGIYYNSGEVCCAGSRVYVEESIYDKFIEEFKAASESIKVGDPFDESTFQGAQTSQMQLNKILKYVDIGKNEGATLITGGERLGSKGYFIKPTVFGDVKEDMRIVKEEIFGPVVTVTKFKSADEVINMANDSEYGLAAGIHTSNINTALKVADRVNAGTVWINTYNDFHHAVPFGGFNASGLGREMSVDALQNYLQVKAVRAKLDE

SEQ ID NO: 91 - DNA, 1494 bp, Saccharomyces cerevisiae
  CDS (1)..(1494)
atgactttgagtaagtattctaaaccaactctaaacgaccctaatttattcagagaatctggttatattgacggaaaatgggttaagggcactgacgaagtttttgaggtggtagaccctgcttccggcgaaatcatagcaagagttcccgaacaaccagtctccgtggttgaggaagcgattgatgttgcctatgaaactttcaagacgtacaagaatacaacaccaagagagagggcaaagtggctcagaaacatgtataacttaatgcttgaaaatttggatgatctggcaaccatcattactttagaaaatggtaaagctctaggggaagctaaaggagaaatcaaatacgcggcttcgtattttgagtggtacgccgaggaagcaccccgtttatatggtgctactattcaacccttgaaccctcacaacagagtattcacaattaggcaacctgttggtgtatgcggtataatttgtccatggaattttccgagcgccatgatcacgagaaaggccgccgctgctttagctgtgggctgcacagtagtcatcaagccagactctcaaacgccgctatctgctttagcaatggcatatttggctgaaaaggcaggctttcccaagggttcgtttaatgttattctttcacatgccaacacaccaaagcttggtaaaacattatgtgaatcaccaaaagtcaagaaagttacttttactggttctacaaacgtcggtaaaatcttgatgaaacaatcttcttctactttgaagaaactgtcttttgagctgggtggtaacgcccctttcatagtctttgaggatgccgatttggatcaagccttggaacaagccatggcttgtaaatttaggggtttgggtcaaacatgtgtgtgcgcaaatagactttacgttcactcatccataattgataaatttgcgaaattactcgcggagagggtcaaaaaattcgtaattggccatggtttggacccaaaaactacacatggttgtgtcattaactccagcgctattgaaaaagttgaaagacataaacaggatgccattgataagggagcaaaagttgtgcttgaaggtggacgtttaactgagttaggtcctaacttttatgctccagtaattttgtcacacgttccctcaacagctattgtttccaaggaggagacttttggtccattatgtccaatcttttcttttgatactatggaagaagttgtcggatatgctaatgatactgagtttggtttagcagcatatgtcttttctaaaaatgtcaacactttatacactgtgtctgaagctttggaaactggtatggtttcatgtaatacaggtgttttttcggattgttctataccatttggtggtgttaaagagtcaggatttggaagagaaggttcgctatatggtattgaagattacactgttttgaagaccatcacaattgggaatttgccaaacagcatttaa

SEQ ID NO: 92 - protein, 497 aa, Saccharomyces cerevisiae
MTLSKYSKPTLNDPNLFRESGYIDGKWVKGTDEVFEVVDPASGEIIARVPEQPVSVVEEAIDVAYETFKTYKNTTPRERAKWLRNMYNLMLENLDDLATIITLENGKALGEAKGEIKYAASYFEWYAEEAPRLYGATIQPLNPHNRVFTIRQPVGVCGIICPWNFPSAMITRKAAAALAVGCTVVIKPDSQTPLSALAMAYLAEKAGFPKGSFNVILSHANTPKLGKTLCESPKVKKVTFTGSTNVGKILMKQSSSTLKKLSFELGGNAPFIVFEDADLDQALEQAMACKFRGLGQTCVCANRLYVHSSIIDKFAKLLAERVKKFVIGHGLDPKTTHGCVINSSAIEKVERHKQDAIDKGAKVVLEGGRLTELGPNFYAPVILSHVPSTAIVSKEETFGPLCPIFSFDTMEEVVGYANDTEFGLAAYVFSKNVNTLYTVSEALETGMVSCNTGVFSDCSIPFGGVKESGFGREGSLYGIEDYTVLKTITIGNLPNSI

SEQ ID NO: 93 - DNA, 1599 bp, Saccharomyces cerevisiae
  CDS (1)..(1599)
atgtcaaacgacggctcaaaaatattgaattataccccagtgtctaaaatagatgaaatagttgaaatctcaagaaatttcttctttgagaaacaattgaaattgtcccacgaaaataacccaaggaaaaaagatctagaattcaggcagttgcagttgaaaaaactctattatgccgtcaaagatcatgaggaagaactgatcgatgctatgtacaaggactttcatcggaacaaaattgaatcggttctgaatgaaacgaccaaacttatgaacgatatacttcacctaattgagattttaccaaaattgatcaaacctcggagagtatctgattcttctcctccatttatgtttggtaaaacaatcgtggagaaaatatcaaggggcagtgtcttgattattgctcctttcaattttcccctacttttagcatttgccccattggcagcagctcttgctgcaggtaacaccattgttctgaagccaagtgaactaacaccacacactgctgtagttatggaaaatttgttaaccacagctggtttccctgatggattgattcaagtagttcagggagctatagatgaaactacaagactactagattgtggaaaatttgacctaatattctacacaggttctccccgtgtcggatcaatagttgctgagaaagcagcaaaaagtctaacaccttgtgtacttgaacttggtggtaaatcacctacctttattacagaaaatttcaaagcaagtaacataaaaattgctttgaaaaggattttttttggtgctttcggaaattctggccagatttgtgtttcaccagattatttgttagtacataaatctatctatccaaaagtcattaaagagtgtgaatcagtactaaatgaattttatccaagctttgatgaacaaacagatttcactcgtatgattcatgagcctgcttacaaaaaggccgttgcaagtataaactcaactaacggctccaagattgtgccttcaaaaatttctatcaattcagatactgaggatctatgccttgtaccaccaaccatagtttataacattggttgggatgatcctttgatgaaacaggaaaactttgctcctgtattgcccatcattgagtacgaggatcttgatgagaccattaacaagataatagaagaacatgacactccattggtgcaatacatattctctgatagccaaactgaaataaatcgtatcttgacgcgcttaagatctggtgactgtgttgtcggtgatacagtgattcatgtaggaattaccgacgctccatttggagggatcggtacttcaggttatggtaactatggtggatattatggattcaatacctttagtcatgaaagaacaatttttaaacaaccatattggaatgattttaccctttttatgagataccctccaaatagcgcacaaaaggaaaagctcgtccgttttgcgatggaaagaaaaccttggtttgacagaaatggcaataacaagtgggggttacgccaatatttttcattatctgccgccgttattttaattagtaccatttacgctcattgttcttcctga

SEQ ID NO: 94 - protein, 532 aa, Saccharomyces cerevisiae
MSNDGSKILNYTPVSKIDEIVEISRNFFFEKQLKLSHENNPRKKDLEFRQLQLKKLYYAVKDHEEELIDAMYKDFHRNKIESVLNETTKLMNDILHLIEILPKLIKPRRVSDSSPPFMFGKTIVEKISRGSVLIIAPFNFPLLLAFAPLAAALAAGNTIVLKPSELTPHTAVVMENLLTTAGFPDGLIQVVQGAIDETTRLLDCGKFDLIFYTGSPRVGSIVAEKAAKSLTPCVLELGGKSPTFITENFKASNIKIALKRIFFGAFGNSGQICVSPDYLLVHKSIYPKVIKECESVLNEFYPSFDEQTDFTRMIHEPAYKKAVASINSTNGSKIVPSKISINSDTEDLCLVPPTIVYNIGWDDPLMKQENFAPVLPIIEYEDLDETINKIIEEHDTPLVQYIFSDSQTEINRILTRLRSGDCVVGDTVIHVGITDAPFGGIGTSGYGNYGGYYGFNTFSHERTIFKQPYWNDFTLFMRYPPNSAQKEKLVRFAMERKPWFDRNGNNKWGLRQYFSLSAAVILISTIYAHCSS

SEQ ID NO: 95 - DNA, 1503 bp, Saccharomyces cerevisiae
  CDS (1)..(1503)
atgactaagctacactttgacactgctgaaccagtcaagatcacacttccaaatggtttgacatacgagcaaccaaccggtctattcattaacaacaagtttatgaaagctcaagacggtaagacctatcccgtcgaagatccttccactgaaaacaccgtttgtgaggtctcttctgccaccactgaagatgttgaatatgctatcgaatgtgccgaccgtgctttccacgacactgaatgggctacccaagacccaagagaaagaggccgtctactaagtaagttggctgacgaattggaaagccaaattgacttggtttcttccattgaagctttggacaatggtaaaactttggccttagcccgtggggatgttaccattgcaatcaactgtctaagagatgctgctgcctatgccgacaaagtcaacggtagaacaatcaacaccggtgacggctacatgaacttcaccaccttagagccaatcggtgtctgtggtcaaattattccatggaactttccaataatgatgttggcttggaagatcgccccagcattggccatgggtaacgtctgtatcttgaaacccgctgctgtcacacctttaaatgccctatactttgcttctttatgtaagaaggttggtattccagctggtgtcgtcaacatcgttccaggtcctggtagaactgttggtgctgctttgaccaacgacccaagaatcagaaagctggcttttaccggttctacagaagtcggtaagagtgttgctgtcgactcttctgaatctaacttgaagaaaatcactttggaactaggtggtaagtccgcccatttggtctttgacgatgctaacattaagaagactttaccaaatctagtaaacggtattttcaagaacgctggtcaaatttgttcctctggttctagaatttacgttcaagaaggtatttacgacgaactattggctgctttcaaggcttacttggaaaccgaaatcaaagttggtaatccatttgacaaggctaacttccaaggtgctatcactaaccgtcaacaattcgacacaattatgaactacatcgatatcggtaagaaagaaggcgccaagatcttaactggtggcgaaaaagttggtgacaagggttacttcatcagaccaaccgttttctacgatgttaatgaagacatgagaattgttaaggaagaaatttttggaccagttgtcactgtcgcaaagttcaagactttagaagaaggtgtcgaaatggctaacagctctgaattcggtctaggttctggtatcgaaacagaatctttgagcacaggtttgaaggtggccaagatgttgaaggccggtaccgtctggatcaacacatacaacgattttgactccagagttccattcggtggtgttaagcaatctggttacggtagagaaatgggtgaagaagtctaccatgcatacactgaagtaaaagctgtcagaattaagttgtaa

SEQ ID NO: 96 - protein, 500 aa, Saccharomyces cerevisiae
MTKLHFDTAEPVKITLPNGLTYEQPTGLFINNKFMKAQDGKTYPVEDPSTENTVCEVSSATTEDVEYAIECADRAFHDTEWATQDPRERGRLLSKLADELESQIDLVSSIEALDNGKTLALARGDVTIAINCLRDAAAYADKVNGRTINTGDGYMNFTTLEPIGVCGQIIPWNFPIMMLAWKIAPALAMGNVCILKPAAVTPLNALYFASLCKKVGIPAGVVNIVPGPGRTVGAALTNDPRIRKLAFTGSTEVGKSVAVDSSESNLKKITLELGGKSAHLVFDDANIKKTLPNLVNGIFKNAGQICSSGSRIYVQEGIYDELLAAFKAYLETEIKVGNPFDKANFQGAITNRQQFDTIMNYIDIGKKEGAKILTGGEKVGDKGYFIRPTVFYDVNEDMRIVKEEIFGPVVTVAKFKTLEEGVEMANSSEFGLGSGIETESLSTGLKVAKMLKAGTVWINTYNDFDSRVPFGGVKQSGYGREMGEEVYHAYTEVKAVRIKL

SEQ ID NO: 97 - DNA, 1527 bp, Candida tropicalis
  CDS (1)..(1527)
atgataagcagaagattttacagtactattgaatcctcaagcaaggttttagccaccttgaagaatccaacacttgttaaaacagatgcttacatcaatgggaattgggtcacttctgcctccggtgaaacctttaaagttacgaaccctgcaacatttcccaaaccagaatctgaactggcaactgttcaatccatggcttctgaggatttcaatagcgccatcgaagcggccaacattgcttttaacagttttaaacacactacaggtaggcacagatcagagttgctgttgaaactttatcagctaatgattgataacaaggaggacttagcgaaaatagtcgtgctagagaatgggaaaccatatgttgatgctttgggtgaagtctcttatgctgcgtctttcttccaatggttttctgaagaagcaccacgtatttatggtgacatcattccttctgctaacggtaagaatagaatcttaactatcaaacaacctattggtgtatgcggaataatgacgccgtggaacttccctttggccatgataaccaggaaagtaggcgccgcaattgcaacaggatgtacaactgtcattaagccagcatctgaaactcctttgtcggctattgcgttggctgttttagctgaggaagcaggatttccgaaaggagtgataaatgtgttgccatcgtcagatgcagctggcgttggcaaacttattaccgagcatcctttgataaagaaggttagttttactgggtcaacccctgttggtaaaatactgatggaacaatcagcaagtaccctaaagaaattgagttttgaactaggtggtaacgctccatttatggtatttgaagatgtagatatagataaagctgttgtaggagcaattgcttccaagttcagaagttcaggccaaacatgtgtgtgtgccaacagaattttcgtacacgaaaaggtatacgacgaatttagccgtaaattggtcgagaagttaacaaaagatgtggtactaggaaatggcttggaccccaaagtgaactatggtccggtcattcatgacaggtctatgaagaaagtgagacagcatattgatgacgctgtttccaagggagcttccatattatatggcgggaacaaaagacccgatttaggagaaaatttccatgagttaacagtattaggtgatgtgacaacggatatgttaatcgctaatgaagagactttcggtccagttgcaccattgatcaaattcaaaaccgatgaagaagttattgagatggccaatgacactacggttggtttagcaggatatttctttgcgaatgacatcacgaaaatatttaagatcgctgaagcccttaatgttggtatgatgggtgttaatactggcgcaatatcagaagctgccctgccattcggtggcattggtgaatctggttttgggagagaaggttcgaagtacggtgtctcagattaccttatcgtcaagtcggcagtcattggtggcattgaagat

SEQ ID NO: 98 - protein, 509 aa, Candida tropicalis
MISRRFYSTIESSSKVLATLKNPTLVKTDAYINGNWVTSASGETFKVTNPATFPKPESELATVQSMASEDFNSAIEAANIAFNSFKHTTGRHRSELLLKLYQLMIDNKEDLAKIVVLENGKPYVDALGEVSYAASFFQWFSEEAPRIYGDIIPSANGKNRILTIKQPIGVCGIMTPWNFPLAMITRKVGAAIATGCTTVIKPASETPLSAIALAVLAEEAGFPKGVINVLPSSDAAGVGKLITEHPLIKKVSFTGSTPVGKILMEQSASTLKKLSFELGGNAPFMVFEDVDIDKAVVGAIASKFRSSGQTCVCANRIFVHEKVYDEFSRKLVEKLTKDVVLGNGLDPKVNYGPVIHDRSMKKVRQHIDDAVSKGASILYGGNKRPDLGENFHELTVLGDVTTDMLIANEETFGPVAPLIKFKTDEEVIEMANDTTVGLAGYFFANDITKIFKIAEALNVGMMGVNTGAISEAALPFGGIGESGFGREGSKYGVSDYLIVKSAVIGGIED

SEQ ID NO: 99 - DNA, 1497 bp, Candida tropicalis
  CDS (1)..(1497)
atgtttaacaaggctctaccgttagtggctaagttaacaaccccaaaaggcttgacctataatcagcctttggggttattcattaacaacgaatttgtgcaacccaaatccaacaaaaccttcgaagtttactctccatctacgggagagaaaatcacggatgtctacgaatcccttgctgaagatgtggacatagccgttgatgcagccaaaacggcttacgataacgggtgggctagtggtgctcctgaacaaagagctaaaattctgtttaaattggctgatttggttgaggaaaaccttgaaaccttggcccaaattgagacttgggacaatgggaaaagtttgcaaaatgcaagaggtgacattggatttacagccgcctactttcgtagttgtggaggttgggccgataagatcaatggctcacagattaatactggcagcaattacttgacctatactcaaagagtaccactaatctcagggcaaataatcccatggaatgcatcaacattgatggcctcttggaagctgggaccagtaatcgcaactggaggtacaactgtactaaagcctgctgaacataccccgttggctgttctgtatttagcgcaactgttagttgaagccggtatgcctaaaggcgtcgtcaatattgtacctggtttcggtgctacaacaggtgcagctattgcttctcatcccaatattgacaaagtggcatttacaggttccactgcaacaggaaaagtgataatgaaacttgcagccgattccaatttgaagaaggtcactttagagttgggtggtaaatctccgaatattgtgttcaatgatgcggacttagacaagactgtccacaaccttgtttctggagtattttctaactcaggtgaaacttgcgctgcgggtgcaagagttctagttcagtcaggcgtatatgatgaagtcgtggcaagattcaagaaagcagctgaggcgataaaggttggcgatccattcgaagaagaaacatttatggggtcgcaagtaaatgaaatccagttctcgaagattcttgagtttgttgagagtggtaaagaacaaggagccactttagttacaggtggtgaaagaatcggggataagggttactttataaaacctactatctttgctgacgtaaagaaggatatgacgattttcaaagaggaaatatttggcccagttgcatcagtcataaaattcgatactattgacgaggcgattgcattggctaatgattcggaatatggcttagctgctggtgtacatactacgaacataaataccggtttacacgttgccaacaatataaaatctggaagcgtttgggtcaacacctatagcgaattgcatccaatggtgccatttggtggatttaaatcctcaggcattggtagggaaatgggtgaagaaagtttcaaggagtatacagaagttaggagcgtcagagttaaactatatcccgatgca

SEQ ID NO: 100 - protein, 499 aa, Candida tropicalis
MFNKALPLVAKLTTPKGLTYNQPLGLFINNEFVQPKSNKTFEVYSPSTGEKITDVYESLAEDVDIAVDAAKTAYDNGWASGAPEQRAKILFKLADLVEENLETLAQIETWDNGKSLQNARGDIGFTAAYFRSCGGWADKINGSQINTGSNYLTYTQRVPLISGQIIPWNASTLMASWKLGPVIATGGTTVLKPAEHTPLAVLYLAQLLVEAGMPKGVVNIVPGFGATTGAAIASHPNIDKVAFTGSTATGKVIMKLAADSNLKKVTLELGGKSPNIVFNDADLDKTVHNLVSGVFSNSGETCAAGARVLVQSGVYDEVVARFKKAAEAIKVGDPFEEETFMGSQVNEIQFSKILEFVESGKEQGATLVTGGERIGDKGYFIKPTIFADVKKDMTIFKEEIFGPVASVIKFDTIDEAIALANDSEYGLAAGVHTTNINTGLHVANNIKSGSVWVNTYSELHPMVPFGGFKSSGIGREMGEESFKEYTEVRSVRVKLYPDA

SEQ ID NO: 101 - DNA, 1503 bp, Candida tropicalis
  CDS (1)..(1503)
atgtctatcccgttgagctttgatgtcactttaccgaatggtgttaaattcactcaacctactggacttttcatcaataacgagtttgtcccttctaagagtggcaagactttggaaagcattaatccctctacaggagaggtcaatggtgaggtttatgcagccgatgcagacgatattgacatagcagtggaagctgctcaaaaggcttttaagacgtggaagaaagtcagtggtgttgagagaggagaatacttgttcaagttggccaaattactggaagagaatagggaactgttaggagccattgaagcatgggattctggcaaaacaaggaataccaatgctgtttacgacattgatgaatgtgtcggagtaaccaaatattatgcaggatgggctgacaaaatcaccggtcaagttatccagaatgatcccaataagctggcttataccgtccatgagccacttggtgtttgcggtcagatcgttccatggaactatccactagcaatggcgttttggaagatcccagttgcagttgccgctggtaatacggttgtattgaaaacatccgagataacccctttatcaatgttgtttgctgcaactttgattaaggaagctggttttcctcctggtgtaatcaacatagtgtctggtttgggaccagttgctggagcagcaatggcgtcacacaagaaaatagccaaaattgcctttacaggttcaactgctacaggtaaagtcattcagaagttggcggctgaaaacctaaaagcatgtacgttggaatgtggcggcaaatcgccgctgattgtaagaggcgatgctgacctagagcaagctgttaaatggggtgcggttgggattatgtccaatcaagggcagatatgcacttcaacaagcagaatctacgtgcatgagtcagtgtatgacaagttcatagaagaatatgcggcgcatgtgaaggaggaatacaaacaaggggacatgtgggatgatgaagctgtagtaggcccacaagttagtaagatgcaagaagaaaagatactaggttacatcaaaattggtaaagaagaaggcgcaagatgtgtaatgggtggtgaaaagaacacagaaggggatcttgctaaaggttactatatcaaacccacagtgtttgccgatgtgacgccagaaatgcgtattgtcaatgaggaaattttcggtcctgtcgttgtaattggcaaattctccacagatgaagaggctattgaatatgccaaccaaactgattacggtttaggagccgctatattcaccaacgacataactgtagcacacaatatggccgccgatattgaagcagggatggtttggattaattcgagtaatgattctgatttgcacattccatttggaggagtgaaaatgtccggtgttggtagagaattaggggaatacggtcttaacatgtatactcaagcaaaagctatacatgtgaacttaggcaacagatta

SEQ ID NO: 102 - protein, 501 aa, Candida tropicalis
MSIPLSFDVTLPNGVKFTQPTGLFINNEFVPSKSGKTLESINPSTGEVNGEVYAADADDIDIAVEAAQKAFKTWKKVSGVERGEYLFKLAKLLEENRELLGAIEAWDSGKTRNTNAVYDIDECVGVTKYYAGWADKITGQVIQNDPNKLAYTVHEPLGVCGQIVPWNYPLAMAFWKIPVAVAAGNTVVLKTSEITPLSMLFAATLIKEAGFPPGVINIVSGLGPVAGAAMASHKKIAKIAFTGSTATGKVIQKLAAENLKACTLECGGKSPLIVRGDADLEQAVKWGAVGIMSNQGQICTSTSRIYVHESVYDKFIEEYAAHVKEEYKQGDMWDDEAVVGPQVSKMQEEKILGYIKIGKEEGARCVMGGEKNTEGDLAKGYYIKPTVFADVTPEMRIVNEEIFGPVVVIGKFSTDEEAIEYANQTDYGLGAAIFTNDITVAHNMAADIEAGMVWINSSNDSDLHIPFGGVKMSGVGRELGEYGLNMYTQAKAIHVNLGNRL

SEQ ID NO: 103 - DNA, 1563 bp, Debaryomyces hansenii
  CDS (1)..(1563)
atgtttaagaactccatcgctaaacaagcccgttctaatgtagcgtatgccaaatctttcatcaggatgtcctccaatcttccacttcaagttagcatcaaattgccaaatggtacaacttatgaacaaccaactggcatgttcattaataacgaatacgtctatccgaaacagaaaaagacctttgatgtcatctccccttctactgaggaacatattactgacgtgtatgaggcattggaagaagatattgatacagccgttgaagctgcaagtgccgcgttcaagtcaagctggtcaacaggtgatccttcagtgagagcgaatgccttgttaaaactagctgacttagttgacgctaatgcagatacactagcacacattgaagccttagataacgggaaaagcctaatgtgctcaagaggagatgttgcactgacagctatgtactttagatcgtgtgctggttgggcagacaagattttgggaactgtaccagaaaccggtagtacccatttcaactacacgcgtagggaacctataggtgtatgcggtcaaattataccatggaactttccgttgttgatgctggcttggaaggttggcccagctactgccacgggcaatacgattgtcctgaaaactgctgaaagcacacctttaagtggcttgttccttactggattgatcaaagaagctggctttccacctggagttgtgaacattctaaccggttttggaaagaatgccggtaatgccattgcttctcatccgaagataaagaaggtggcgtttacaggttctactgcgacagggagacatatcatgaaaagtgcagcagagtcgaatttaaagaaggttacattagaattaggaggtaaatctcccaacatagtattcaacgatgctgacgttcagaaatcagctcaatcattaattacagggattttctataacactggcgaagtgtgttgtgctggttccagaatctatgtacaggaagagatttatgataatgtcttagaagaactaaagaatgcttcttcgaaaatcaaaattggaaatcccttcgaagaagatacttttatgggtgctcaagcatcatcccaacagcttgataagatactgaagtacatagagactggaaagaatgaaggggccaaattgattagtggtggcgaaagagtccaagggaaaggatactttataaaacccactatctttggtgacgttaccgaggacatgcaaatagtcaaagaagagatattcggtcctgttgtgactattacgaaattcaaaaccattgatgaagtagtcgatttggcaaatgactctgaatacggtttggcagctggtattcataccgagaacataaatacagccattggtgttgcaaataggttacaagctggcacagtttgggtaaacacctataatgattttcacccaatggttccatttggtggttatggacaatctgggtttggcagagagatgggtgcagaagcacttgataactacacccaggttaaggctgtgagaatcggtttgacggagaaacac

SEQ ID NO: 104 - protein, 521 aa, Debaryomyces hansenii
MFKNSIAKQARSNVAYAKSFIRMSSNLPLQVSIKLPNGTTYEQPTGMFINNEYVYPKQKKTFDVISPSTEEHITDVYEALEEDIDTAVEAASAAFKSSWSTGDPSVRANALLKLADLVDANADTLAHIEALDNGKSLMCSRGDVALTAMYFRSCAGWADKILGTVPETGSTHFNYTRREPIGVCGQIIPWNFPLLMLAWKVGPATATGNTIVLKTAESTPLSGLFLTGLIKEAGFPPGVVNILTGFGKNAGNAIASHPKIKKVAFTGSTATGRHIMKSAAESNLKKVTLELGGKSPNIVFNDADVQKSAQSLITGIFYNTGEVCCAGSRIYVQEEIYDNVLEELKNASSKIKIGNPFEEDTFMGAQASSQQLDKILKYIETGKNEGAKLISGGERVQGKGYFIKPTIFGDVTEDMQIVKEEIFGPVVTITKFKTIDEVVDLANDSEYGLAAGIHTENINTAIGVANRLQAGTVWVNTYNDFHPMVPFGGYGQSGFGREMGAEALDNYTQVKAVRIGLTEKH

SEQ ID NO: 105 - DNA, 1506 bp, Debaryomyces hansenii
  CDS (1)..(1506)
atgtccttaccacttgagtataacgtgactctgccagatggtaacaagttctctcaaccatctggcttgtttatcaataacgagtttgtcaaaagtaaatcaggtaaaactatcgagagcattaacccatcaactggcgaagttaatggctctgtttatgcagccgatgaagaagatgttgactctgccgttaaacacgcaagaaatgcattccatgctgtttggaggaaaactacaggtgttgctagaggggatctactgaacaagtttgctcaagttttgcaagaacagagagacttaattggtgctatagaggcatgggattctggcaagacaaaggaacagaatgcagtctacgacattgatgaatgcatcaattgcttcaagtactttgctggttgggcagataaaattcagggaaaagtgattcagaatgacccgaagaaattggcgtacacggttcacgaaccttttggtgtttgtgctcaaatcattccctggaattaccctttagctatggctgcctggaaattagcgcctgcattggctgctggaaatgtagtagtgttgaaaagtagcgaagtcacacccctttccatactatacctagccaaaatcttcagagatgttggttttccacctggtgtagtgaacatcttatcaggttatggtgctacttgtggcaaggccttagcttcccatcttgacgtagataagatcgcttttacaggctcgactgcaacggggaagttgattcaacaaatggcatcgagtaaccttaaggccgttaccttggagtgtggtggtaaatctccgttgattgtgagaaaagatgcggatctggaacaagcagtaaagtgggctgctatagggattatgagtaatcagggtcagatttgcacatccacttcaagagtttatgttcatgagtctgtatatgataccttcttgacaatgtatgccaagcacataaaagaagaatatgtgcaaggcgatatgtttgaaaagaacgcgatcgtcggtccacaagtctccaaacaacaatttgacaaaatcctgtcgtacatagacattggtaagaaagaaggtgctagagtcattttaggtggggaaaagaatagtgacggaaatatgtctaaaggtttctttgtcaaacctaccatattcgccgatgtcaaacccgatatgcgtattgtaaatgaggagattttcggaccagttgtgacatgtggaaaatttgccagtgacgaagaagctataaagtatgcaaatcaaacccaatatggtctaggtgcagcaattttcactagcgatataaccaaagcacattccatggcgtcagatatacaagccggaatggtgtggataaactcaagcaatgactcagattgtcatgtaccttttggaggggtcaagatgtcaggagttggcagggaattaggagaatacggcttgtctatgtatacgcaagctaaagccatttacgttaacttaggtactcatttg

SEQ ID NO: 106 - protein, 502 aa, Debaryomyces hansenii
MSLPLEYNVTLPDGNKFSQPSGLFINNEFVKSKSGKTIESINPSTGEVNGSVYAADEEDVDSAVKHARNAFHAVWRKTTGVARGDLLNKFAQVLQEQRDLIGAIEAWDSGKTKEQNAVYDIDECINCFKYFAGWADKIQGKVIQNDPKKLAYTVHEPFGVCAQIIPWNYPLAMAAWKLAPALAAGNVVVLKSSEVTPLSILYLAKIFRDVGFPPGVVNILSGYGATCGKALASHLDVDKIAFTGSTATGKLIQQMASSNLKAVTLECGGKSPLIVRKDADLEQAVKWAAIGIMSNQGQICTSTSRVYVHESVYDTFLTMYAKHIKEEYVQGDMFEKNAIVGPQVSKQQFDKILSYIDIGKKEGARVILGGEKNSDGNMSKGFFVKPTIFADVKPDMRIVNEEIFGPVVTCGKFASDEEAIKYANQTQYGLGAAIFTSDITKAHSMASDIQAGMVWINSSNDSDCHVPFGGVKMSGVGRELGEYGLSMYTQAKAIYVNLGTHL

SEQ ID NO: 107 - DNA, 1476 bp, Debaryomyces hansenii
  CDS (1)..(1476)
atgtcaaagcctacgttaaacaacccagacctaatccgtactaaaccctatataaatggagaatggtttgagtccaaatccactaaaactttcaaagtcattgatcctgcgacagaaacagaaatagttgagttaccagatcagactcctgaagagatagcatttgctatcgaaaaggctgaagaagccttcaaaacgtttaagaaaacgaacgcatacgatagagctagatggctaagaaagttaaatgacttgatgttagagaacatcgaagatttggccaagatacttacatgggaaaatggtaaatgcttgacagatgctacaggggagatcaagtatgccgcaagttactttgaatggttcgctgaagaagccaaaagaatctatggtaatacgatacaaccgtctaacaacaacaacaaagtcattacttacaaacagcccattggagtggtaggtttactgtgtccgttcaattttccaactgcaatgggtgcaaggaaacttgcccctagtttcgctgcagggtgtactactattttgaaacccgatggccaaaccccactgtcaagtctagctcttgcttatttggctgagaaagccggtttccctaaaggcacctttaacgttgtccttgcctctaccgaaaacacaccaaaggtggggctagagttctgcgaatctcctaggataaagaagatttcctttacaggttcaacaccagttggcaaactgttaatgagacaatcttccagcactttaaagaaattgtcgatggaattgggcggaaatgcgccaataatcatctttgacgacgctgatcttgacttagccgttgaacagtctattgcctctaaattcaggagtttggggcaaacctgtgtttgtgcaaatagactatacattcaatcaggcgtctatgataagttttgtgagaagtttactgagaaagtgaaagagttcaaaattggtaatggtctggaaaagggaattacacatggttgcttgattaatgataaggcaattacaaaagttgaagaacacatcaaagatgcagttgggaaaggtgctaaggttttagttgaaggtggtagactacctaatttgggtaagaacttctatgctccatccgtagtcaaagatgtaacccaagaaatggtggttgtaaaagaagaaacctttggaccattggcggcactgtctaagtttgacactaaagaacaagtgttggattggtgtaatgatacaccgtacggattagcttcatatgttttctcggagaatttaaatactatttggtttatgagcgagtacttggaaagcggtatggtagctgtgaataccggtttgtttactgatgctgcaatgccatttggaggtgttaaggaatcaggatttggcagagaaggctcgttatacggtatagacgactatacggtagtcaaggcgattaccttgggtaatatgtatcgt

SEQ ID NO: 108 - protein, 492 aa, Debaryomyces hansenii
MSKPTLNNPDLIRTKPYINGEWFESKSTKTFKVIDPATETEIVELPDQTPEEIAFAIEKAEEAFKTFKKTNAYDRARWLRKLNDLMLENIEDLAKILTWENGKCLTDATGEIKYAASYFEWFAEEAKRIYGNTIQPSNNNNKVITYKQPIGVVGLLCPFNFPTAMGARKLAPSFAAGCTTILKPDGQTPLSSLALAYLAEKAGFPKGTFNVVLASTENTPKVGLEFCESPRIKKISFTGSTPVGKLLMRQSSSTLKKLSMELGGNAPIIIFDDADLDLAVEQSIASKFRSLGQTCVCANRLYIQSGVYDKFCEKFTEKVKEFKIGNGLEKGITHGCLINDKAITKVEEHIKDAVGKGAKVLVEGGRLPNLGKNFYAPSVVKDVTQEMVVVKEETFGPLAALSKFDTKEQVLDWCNDTPYGLASYVFSENLNTIWFMSEYLESGMVAVNTGLFTDAAMPFGGVKESGFGREGSLYGIDDYTVVKAITLGNMYR

SEQ ID NO: 109 - DNA, 1512 bp, Pichia pastoris
  CDS (1)..(1512)
atgaactccctatcaaaagctgctaagatgtcaattagcagtttagcatctacttacggcattaagaatgtgaacttgcttagaactcaaggtttcattgatggtaagtgggttggggattctacgtcaaccttcgacgtcaccaatcctgcgacagatgatcttctgttgaaagtatctaatctaactgttgacgatgcccataaagccataaaatcgtcgtcagacgcattcaagtctttcaagactactactgccagatatagagcggatattttaaacaagatgtatcacttgttgatggataatgtggatgacttggccataatctgttctttggagaatggtaaacccgttgctgattcagctggtgaagttaagtatgcagcctccttttaccaatggtttggtgaagaagcacaaagacttacaggagatgtcataccctcgaatatcccgagtaatagaatcatcactgttaaacagccagtaggagttgtgggcatattgacgccttggaattttcctctggcaatgatttctaggaaagtgggtgctgctattgcgaccggatgtacagctgtggttaagccagcatctgaaacaccattaagtgcgttagcaatggcctatttagctcatgaagctggtttgccaaaaggcgtgttcaatattctgcctgtcgatcatgctacaactaagtctattggtgagttgttttgtgaggatgataccattaagaaagtttcattcacagggtctacaggagtaggttcagtgttgatgacgcagagtgcaaagactctaaagaaattatcctttgaactgggaggtaatgccccgtttatagtctttgaagatgcagacatagacaaagcagttgagggtgctttgatctctaaactacgtcaaagtggacaaacctgtgtttgtgctaacaggttatacattcacgagagcatctacgatgaatttaccgagaaactggttgccaaggttaagaaatgcaaattgggcaatggtttaacagaaggcaccacacatggcccattggttcattccagagcggtagacaaagtccaacaacacgtaaaagactgccttgataaaggagctactcttttgttgggcggtaaagttcgtacagacttaggacccaattttcacgatttaactgtcattggtgatgtcacgcaagagatggctgttgcccatgaagaaacgtttggtccattagtcccattgataaaattttccagcgaagaacaggttttagaatgggcaaacgatacagaatttggtctagccgggtatttctttactaacaactatagtaggattttcagacttggagaacagattgaatgcggtatggtagggatcaacactggtgcaatcagcgaagctgctgtacctttcggtggcattaagcattccgggttcggtagagagggttcaaaatatggcgtgaatgactacataaacattaagaccatggtaataggaggtcta

SEQ ID NO: 110 - protein, 504 aa, Pichia pastoris
MNSLSKAAKMSISSLASTYGIKNVNLLRTQGFIDGKWVGDSTSTFDVTNPATDDLLLKVSNLTVDDAHKAIKSSSDAFKSFKTTTARYRADILNKMYHLLMDNVDDLAIICSLENGKPVADSAGEVKYAASFYQWFGEEAQRLTGDVIPSNIPSNRIITVKQPVGVVGILTPWNFPLAMISRKVGAAIATGCTAVVKPASETPLSALAMAYLAHEAGLPKGVFNILPVDHATTKSIGELFCEDDTIKKVSFTGSTGVGSVLMTQSAKTLKKLSFELGGNAPFIVFEDADIDKAVEGALISKLRQSGQTCVCANRLYIHESIYDEFTEKLVAKVKKCKLGNGLTEGTTHGPLVHSRAVDKVQQHVKDCLDKGATLLLGGKVRTDLGPNFHDLTVIGDVTQEMAVAHEETFGPLVPLIKFSSEEQVLEWANDTEFGLAGYFFTNNYSRIFRLGEQIECGMVGINTGAISEAAVPFGGIKHSGFGREGSKYGVNDYINIKTMVIGGL

SEQ ID NO: 111 - DNA, 1575 bp, Pichia pastoris
  CDS (1)..(1575)
atgttaagaacttctcctgctacaaagaaggcattgaagtcacaaattaacgcttttaacgttgctgcactaaggttttatagctcacttcccttgcaagtacccataactttgcctaatggcaagacctacaatcaacctactggtcttttcataaataatgagttcgttccatccaagcaaggcaaaacgtttgcggttctgaatccctcgacagaagaggaaattacacatgtgtatgaaagtagagaggatgatgtcgaacttgcagttgccgctgcacagaaagcctttgactccacatggagcacccaagatccagcggaaagagggaaagtcctaaacaagttagctgatttgatcgaagagcattctgagacattagcggccattgagtccttagacaatggcaaagcaattagctctgccagaggcgatgtagggttagttgtggcctatttgaaatcatgtgctgggtgggctgacaaagtgtttggtagggtagtggaaaccggttcttctcacttcaattacgttagaagagagccattaggagtttgtggacaaatcattccttggaattttccgttgctaatgtggtcctggaaggtcggtcctgctctggcaacaggtaacactgttgtcttaaagactgcggaatctacgccgttatcagccttatacgtgtctcagctagtaaaggaagctggtattccagccggtgttcacaacattgtgagtggctttggaaagataaccggcgaagcaatagctactcatccgaaaatcaagaaagttgcattcactgggagtactgctactggtcgtcacattatgaaagcagcagcagaaagcaatttgaagaaagtgactttggaattgggaggaaaatcaccaaatattgtgttcaacgacgctaatatcaaacaagctgtcgcgaatattatattgggtatttactataattcaggtgaagtttgctgtgcaggatcacgtgtctatgtccagtctggtatctatgatgaactactggctgagttcaaaacagccgctgagaacgtaaaggtaggtaatccattcgatgaagatacctttcaaggtgctcaaaccagtcaacagcaattggagaaaattctgggctttgtagaaagaggcaagaaggatggtgccactcttattacgggtggtgggagacttggagacaaagggtatttcgtgcaaccaacgatctttggtgatgttacccctgaaatggaaatagtaaaagaagaaatctttggaccagtcgttacaatttcgaaattcgacacgatagatgaagttgtagacttagcaaatgattcgcagtatggtttggcagctggtattcatagtgatgacattaacaaagtcatagatgtagccgctagaatcaaatctggcacagtttgggtcaatacttacaatgatttccatcaaatggttccatttggtggttttggacaatccggtataggaagagaaatgggtgttgaagccttggaaaactacacacagtacaaagctataagggttaaaatcaaccataagaacgaa

SEQ ID NO: 112 - protein, 525 aa, Pichia pastoris
MLRTSPATKKALKSQINAFNVAALRFYSSLPLQVPITLPNGKTYNQPTGLFINNEFVPSKQGKTFAVLNPSTEEEITHVYESREDDVELAVAAAQKAFDSTWSTQDPAERGKVLNKLADLIEEHSETLAAIESLDNGKAISSARGDVGLVVAYLKSCAGWADKVFGRVVETGSSHFNYVRREPLGVCGQIIPWNFPLLMWSWKVGPALATGNTVVLKTAESTPLSALYVSQLVKEAGIPAGVHNIVSGFGKITGEAIATHPKIKKVAFTGSTATGRHIMKAAAESNLKKVTLELGGKSPNIVFNDANIKQAVANIILGIYYNSGEVCCAGSRVYVQSGIYDELLAEFKTAAENVKVGNPFDEDTFQGAQTSQQQLEKILGFVERGKKDGATLITGGGRLGDKGYFVQPTIFGDVTPEMEIVKEEIFGPVVTISKFDTIDEVVDLANDSQYGLAAGIHSDDINKVIDVAARIKSGTVWVNTYNDFHQMVPFGGFGQSGIGREMGVEALENYTQYKAIRVKINHKNE

SEQ ID NO: 113 - DNA, 1503 bp, Pichia pastoris
  CDS (1)..(1503)
atgacgttcgcacctccattggaatttgaaatagacttaccaaatggtcttaaatacactcaacctttaggactattcattaataacgagttcgttgaaggggttgaaggtaaacttttgcccgttattaatccctgtgatgagactaaaattactcaagtttgggaggcatcagctgcagatgtagacagagcagttgacgcagcagaagatgcgtttaacaactctgtttgggccacacaagatcctttggaaagaggcaaattgatgaacaagctggcagacctaattgatagagattttaacattcttgctggcattgagtccattgacaacggtaaggcatacacttcagcacaaggtgatgtcactttggccgtgaactatatccgttcttgtgctggatgggccgataagattctaggtaatgttgtggactcagggaatacacacttgaatttagttaagagagaaccacttggagtcgtaggtcagataattccgtggaactttccgttactgatgttagcttggaagctgggtccagctttggcaactggtaatacggttgtgcttaagacggctgagagcacgccactatctggcttatatgttgccaaattaatcaaggaagcgggttttccacctggtgtggtcaatatattgtcgggttttggcaatcctgcgggtgctgcaatcgctgctcatcctcgtattaagaaaatcgcgttcactggatctacagcaacaggtaggaaaattatggaagctgctgctaagtcaaatttgaagaaagtgactttagagttaggcggcaaatccccaaacatagttttcgaagatgctgacatccagaaaacaattcacaatatcatcttggggatattcttcaacagtggagaagtatgctgtgctggttccagagtttatatccaagatactgtgtatgaagaagttttggaggccttcaagaaggaaaccgacaatgtgaaagttggtgggccatttgaagaaggtgtctttcaaggtccgcaaacctctgaattacagctaaataggattctgagctatatcaagcatggcaaagatgaaggagccagagtaattacaggaggttcgagatacaggaatagaggttactacataaaaccaaccatatttgctgatgtcaccgaagatatgaaaatagtaaaagaggagatatttggacctgtagtcacaataactaaattcagtacagtagatgaagtcgttggttatgctaataataccaattacggtctagccgccggcatacacaccaacaatttgaacaaggcaatcgacgtcgctagtagaatcaaagctggagttgtgtggattaacacctacaatgattttcatcatatggtaccctttggtggatatggggaatctgggattggcagagaattgggtgcggaagccttagataactatactcaagcaaaagccattagaattgcctatacaccagagcataaa

SEQ ID NO: 114 - protein, 501 aa, Pichia pastoris
MTFAPPLEFEIDLPNGLKYTQPLGLFINNEFVEGVEGKLLPVINPCDETKITQVWEASAADVDRAVDAAEDAFNNSVWATQDPLERGKLMNKLADLIDRDFNILAGIESIDNGKAYTSAQGDVTLAVNYIRSCAGWADKILGNVVDSGNTHLNLVKREPLGVVGQIIPWNFPLLMLAWKLGPALATGNTVVLKTAESTPLSGLYVAKLIKEAGFPPGVVNILSGFGNPAGAAIAAHPRIKKIAFTGSTATGRKIMEAAAKSNLKKVTLELGGKSPNIVFEDADIQKTIHNIILGIFFNSGEVCCAGSRVYIQDTVYEEVLEAFKKETDNVKVGGPFEEGVFQGPQTSELQLNRILSYIKHGKDEGARVITGGSRYRNRGYYIKPTIFADVTEDMKIVKEEIFGPVVTITKFSTVDEVVGYANNTNYGLAAGIHTNNLNKAIDVASRIKAGVVWINTYNDFHHMVPFGGYGESGIGRELGAEALDNYTQAKAIRIAYTPEHK

SEQ ID NO: 115 - DNA, 1479 bp, Schizosaccharomyces pombe
  CDS (1)..(1479)
atggcgccacagtttaagcgtccagagttattcggctttgacaaaagtcatgcccaatcatttgtacaaggaaagtggattagtagtccgaataataagactttcgaagtagacaatccagctactggtgagattatcggaaaggttgctgatgtttcggttgaagaaacaaagaaagctatttctgctgcaaacgaagcatttaaaacctacaagaactttactcacgttcaaagatcgcaattgctagaaagatgggctgaattgatcatggagaacaaagacgatttagtcaaaatgttaactcttgaaaatgggaagcccctatctcaagcagaaatggaagtgacaacatgttccgggtatctaaaatggtatgccgccgaagcagtgagaacgtttggtgatgttgctccttcatctctgcaatcccagaatttcttgattagcataaaacaaccagtgggcgtttctgccttgatcactccttggaattttcctgctgccatgatagccagaaaaggaggtgcagcactagcagccggatgtactgctatattcctgccagcattcaggacaccatacgtctgtttgggtttggtcagattagcacaagaagccggttttcctgatggggttcttaacgttataacgtcgtctgatgcatctgctcatggcaaggaacttacaactaacccaatagtcagaaaagtctcttttacagggtcaactaatgttggtaaaatcttaatgggccaatccgcttctaccattaagaaagtgagcatggagcttggtggtaatgcaccattcatcgttttccctgactttcctattgatcaggctgttgagtctttctgcacgatcaaatttaactcatgcggtcaagtctgtgtttgccccaatagggtatatgttcataagaacgtttacgacgagtttgttagtaaactaacagaaaaggtcaaaaccattaaggttggtgatggtttcgatagctcaagcgctgtaggaccgttaatctcccaagatggctgtaagaaggtgtcaaaacacattgaagatgctgtctctaagggtgctaagattaccgtcggaggtaaagaaatttcctcgtcaaaaggctacttctttgaaccaacagtgttgagtggtgtaacccaagacatgttggttgcgtccgaagagacttttggtcccttggcttcagtatttaagttcgacgatactgaagaagttattgaatgggcaaatgatagtgatgtagggttagcgggttatgtgtttacgaacaatttatccacaatgattcatgtcgcgaaagaactggaagtgggtttagtaggtgcgaatatagagatggtagatgagccgttcatatcatttggcggcataaaacagtctggtttcggaaaagaagccggaagattgggagttcaggaatttatggtagtgaaagagattaacctgaaaaccttg

SEQ ID NO: 116 - protein, 493 aa, Schizosaccharomyces pombe
MAPQFKRPELFGFDKSHAQSFVQGKWISSPNNKTFEVDNPATGEIIGKVADVSVEETKKAISAANEAFKTYKNFTHVQRSQLLERWAELIMENKDDLVKMLTLENGKPLSQAEMEVTTCSGYLKWYAAEAVRTFGDVAPSSLQSQNFLISIKQPVGVSALITPWNFPAAMIARKGGAALAAGCTAIFLPAFRTPYVCLGLVRLAQEAGFPDGVLNVITSSDASAHGKELTTNPIVRKVSFTGSTNVGKILMGQSASTIKKVSMELGGNAPFIVFPDFPIDQAVESFCTIKFNSCGQVCVCPNRVYVHKNVYDEFVSKLTEKVKTIKVGDGFDSSSAVGPLISQDGCKKVSKHIEDAVSKGAKITVGGKEISSSKGYFFEPTVLSGVTQDMLVASEETFGPLASVFKFDDTEEVIEWANDSDVGLAGYVFTNNLSTMIHVAKELEVGLVGANIEMVDEPFISFGGIKQSGFGKEAGRLGVQEFMVVKEINLKTL

SEQ ID NO: 117 - DNA, 1494 bp, Schizosaccharomyces pombe
  CDS (1)..(1494)
atgtctacaagttcaaaattgagcaccaacataaaggacttgtctctattcgatcttgaagagtttccagcaagatcatacataggcggtaagtgggttactgcagcttccggtaagacctttgatgttgaaaaccctggattgaatgaaacacttgctccagttactgatatgagtgtcgaagaaactcgtaaggctattaaggtggctcatgaagcgttcttgtcgtacagaaattcagatataaaagagaggtatgcgatcttgagaagatggtatgacctaattatggaaaatgcggatgatttagcaacaatgatgacattggagaatggtaaggctttaggtgacgctaaaggtgaagtggtctatgctgcaaaattcatagattggtttgctggtgaagccttaaggatttctggagattcttcaatgtcatccaacccgcaaaacaggattattaccatcaagcaacctgttggagttgttggcatcatcaccccatggaactttccagcggctatgatcacaagaaaagtaggtgccgctttagcagccggatgtaccgttgtgataagaccagccgctgagacaccattcactgctttagctttggcaaaactagcggagagagctggtgttcctgcaggcgtgctaaatatggtgactgctaattctccttccgaacatggtattgaactgactactaatccccttattagaaaagtctcctttaccgggtctactaacgttggcaaaattttggcaaaacagagtagttccacgctaaagaaattatctttggaattaggcggtaatgctcccttcatagtctttgaagatgccgatctggagaaagctgcagatgcgctgatggcttgcaagtttcgtggaagtggtcaaacttgtgtgtgtgcaaataggatatatgtccactcttccgtttatgacgcctttgttgacctggtcacggaaagagtctcgaaattcaaactaggatatgggttagatgccggtgtgactcatggtccattaatctcggagaaagcaatcagcaaagtgaaacagcacgtagaagatgctgtacaaaagggcggtgtagtagtaacgggcggtaaagttgcatcaaacttaggacctatgtactttgaaccgactgtaattattaacgcaaaacaaggtatgttgatttctgaagaggaaacattcggtccagtgggtgccttatttaagtttgataccgaagatgaagttgtcgcatgggccaatgattcccctgttggtcttgccggttatttgttttcaaaggacatttcgagagtattcagagttggcgaagcccttcaagtaggaatggttgggtgcaatacgggtttagttagtgacgtcttgtctcccttcggaggcgttaaggaatcaggatttgggagagaagggtctaaatacggtatatcagagtacttggacattaagagcctgacaatcagcacattg

SEQ ID NO: 118 - protein, 498 aa, Schizosaccharomyces pombe
MSTSSKLSTNIKDLSLFDLEEFPARSYIGGKWVTAASGKTFDVENPGLNETLAPVTDMSVEETRKAIKVAHEAFLSYRNSDIKERYAILRRWYDLIMENADDLATMMTLENGKALGDAKGEVVYAAKFIDWFAGEALRISGDSSMSSNPQNRIITIKQPVGVVGIITPWNFPAAMITRKVGAALAAGCTVVIRPAAETPFTALALAKLAERAGVPAGVLNMVTANSPSEHGIELTTNPLIRKVSFTGSTNVGKILAKQSSSTLKKLSLELGGNAPFIVFEDADLEKAADALMACKFRGSGQTCVCANRIYVHSSVYDAFVDLVTERVSKFKLGYGLDAGVTHGPLISEKAISKVKQHVEDAVQKGGVVVTGGKVASNLGPMYFEPTVIINAKQGMLISEEETFGPVGALFKFDTEDEVVAWANDSPVGLAGYLFSKDISRVFRVGEALQVGMVGCNTGLVSDVLSPFGGVKESGFGREGSKYGISEYLDIKSLTISTL

SEQ ID NO: 119 - DNA, 1509 bp, Schizosaccharomyces pombe
  CDS (1)..(1509)
atgtctactaagttggtagaccatgtcgaaattaccgtacctactgggaaaacctacattcaaccagttggcttgttcatcaacaatcaacatgtggattcggtgcatggcggaagagttaaggtgtactctccgtcaactgagaagttaatttgtgaagttgctgatgctgacgaagaagatgtggatatagccgtgaaagtcgctagagccgcttttcaaactgatgccccttggagaaaatttagctcagcccaaagaggtagatgcctttccagattagcagattgcatagaacagaatctggaatatctagcttccatagagactttagataacgggaaaagcattacgttggccagaggagatgttcaagctgcagcagactgttttaggtactatggaggatgggctgataaggactatggccaaactattgaaacggacattaagagattcgcttacaccagacatgaacccattggtgtttgtggtcagattatcccatggaactttccattcttgatgtgtgcctggaagattgcccctgcagttgcatgtgggaataccataattcttaaaacagctgaacttacacccttaagtgctctatgtctgacaaagttcgtaccagaatgtggttttccaccaggagtcatcaatgtcttgtctggggatggtagacgttgcggaaatgccatttcctcacacatggacatcgacaaggttgcgtttactggcagtactggcgttggtagaatggttatgcgtgcagcagcctcttctaaccttaagaaagttaccttagagctaggcgggaaatcccctaatatcgtattcaacgacgcagatttggattcggctgctgtatggacaaactacggtattttctacaattctggtcaagtttgctgtgcgggttctagggtttacgtccaagaggatgtttatgacgagtttatcaagaggatggttgcgaaagctaaaacattgaaagtcggtgatccgtttgcagaggatacttttcaaggtgctcaggtatcgaaacagcaatatgagaggatagtctcatacatagaatccggaatagcacatggtgccaaactggaaattggcggaaagagacacggtaatttgggttatttcgtcgaaccaacaatcttgtcaaatgtcactgaagatatggctgtgggtaaagaggaaatatttggtcctgtattagcagttataaaattcaaaacgatcgaagaagctattagaagaggtaataacagcacatatggattagcggctggtgtacacacgaataacattaccaatgcgatcaaagtgagtaatgcattggaagctggtactgtgtgggttaactgctataacttactacatcatcagattccttttggcggttataaggaatctggtattgggcgtgaattaggctcatatggtttgaccaattatacacaaacaaaagcagtacacatcaatctgggaatggatagtcccata

SEQ ID NO: 120 - protein, 503 aa, Schizosaccharomyces pombe
MSTKLVDHVEITVPTGKTYIQPVGLFINNQHVDSVHGGRVKVYSPSTEKLICEVADADEEDVDIAVKVARAAFQTDAPWRKFSSAQRGRCLSRLADCIEQNLEYLASIETLDNGKSITLARGDVQAAADCFRYYGGWADKDYGQTIETDIKRFAYTRHEPIGVCGQIIPWNFPFLMCAWKIAPAVACGNTIILKTAELTPLSALCLTKFVPECGFPPGVINVLSGDGRRCGNAISSHMDIDKVAFTGSTGVGRMVMRAAASSNLKKVTLELGGKSPNIVFNDADLDSAAVWTNYGIFYNSGQVCCAGSRVYVQEDVYDEFIKRMVAKAKTLKVGDPFAEDTFQGAQVSKQQYERIVSYIESGIAHGAKLEIGGKRHGNLGYFVEPTILSNVTEDMAVGKEEIFGPVLAVIKFKTIEEAIRRGNNSTYGLAAGVHTNNITNAIKVSNALEAGTVWVNCYNLLHHQIPFGGYKESGIGRELGSYGLTNYTQTKAVHINLGMDSPI

SEQ ID NO: 121 - DNA, 1623 bp, Aspergillus oryzae
  CDS (1)..(1623)
atgccgctttgtccttcacctctattaacccgtttgtgcttaagaggtccaccgttattcaagttaccactttcctcctcacttccaaggcgtttgttctattctagtccagccataatgagtgatgttactgttcagttgacagctcccaatggtagaaaatatgcccaacccattggtttgttcatcaacaatgagttcgtaccaagcaaatcaggcgaaaagttcgctactatcaatccagcggatgagaaggagattgcgtcggtttatgctgcaggagaggaagatattgacatagcagtcaaggctgcaagaaaagcgttcaaagatcctagctggaagctgttaccacctactgatagaggggctttgatgctaaaactagcagacttaattgaacaacacagagaaattttagccaccatcgaaacttgggataatggtaaaccatattccgtttctctatcgtctgatctgggtgaagtcattaatactctgcgttattatgccggttgggcagataaagtacatgggcagacaatttccacgactcctgataagttagcttacacactaagacagcctattggcgttgttgggcaaatcattccctggaattttcccttggctatggctgcttggaaattgggtccagccttggcttgtgggaatactattgtgatgaaaccagccgaacagacccctttaagtatcctttacttagctactttgatcaaagaagccggttttcctccgggtgttattaacattgtgaatggattgggaagagttgcaggatcagccttggttacacatccagacgtcgataaagtcgcatttactggatcaacattgacgggcagagaagtgatgaagttggctgctggtactttgaagaacataacgttggaaacaggagggaaatcaccgctggtcgtgtttggtgatgccgatatagaacaagctgctaaatgggcacatattggaattatgtacaaccaaggccaagtatgtacagcaaccagtagaatcctagtacatgagagcatatacgacaagtttatagagttatttaaacaggaagtagcatcagttagtaaggtgggtgatccttttgcagacgatacctttcaaggtccacaagttaccaaggctcaatacgacagggtgttgtcctacattgaagctggcaaatccgaaggtgcgacattagtagctggaggcgaaccatacaagaacgtgggtgatggtaaagggttcttcatagctcctacgatatttacgaacgtcaaagataacatgaggatctatagggaggaagtatttggcccatttgtggttatatcgtctttcgctgcagaagatgaagcagtcacaagagccaatgacactacatatggcttaggcgcggcaattttcaccaaggacatcgaaagagcacacagagttgcctctgaaatagaggctggtatggtttggataaactcttctaatgattctgactttagagtaccctttggtggtatcaagcaaagtggtattggaagagaacttggtgaggcaggacttgaagcgtattctcaagtcaaagccattcacgttaatctaggtagcaaactg

SEQ ID NO: 122 - protein, 541 aa, Aspergillus oryzae
MPLCPSPLLTRLCLRGPPLFKLPLSSSLPRRLFYSSPAIMSDVTVQLTAPNGRKYAQPIGLFINNEFVPSKSGEKFATINPADEKEIASVYAAGEEDIDIAVKAARKAFKDPSWKLLPPTDRGALMLKLADLIEQHREILATIETWDNGKPYSVSLSSDLGEVINTLRYYAGWADKVHGQTISTTPDKLAYTLRQPIGVVGQIIPWNFPLAMAAWKLGPALACGNTIVMKPAEQTPLSILYLATLIKEAGFPPGVINIVNGLGRVAGSALVTHPDVDKVAFTGSTLTGREVMKLAAGTLKNITLETGGKSPLVVFGDADIEQAAKWAHIGIMYNQGQVCTATSRILVHESIYDKFIELFKQEVASVSKVGDPFADDTFQGPQVTKAQYDRVLSYIEAGKSEGATLVAGGEPYKNVGDGKGFFIAPTIFTNVKDNMRIYREEVFGPFVVISSFAAEDEAVTRANDTTYGLGAAIFTKDIERAHRVASEIEAGMVWINSSNDSDFRVPFGGIKQSGIGRELGEAGLEAYSQVKAIHVNLGSKL

SEQ ID NO: 123 - DNA, 1515 bp, Aspergillus oryzae
  CDS (1)..(1515)
atgcctgaattggatttgtttctggatattactgcacccaatgggagacaatacaaacaacctacaggtctattcattgacaatgagtttgtgaagtctaccagcggtcagactattgctagtatcgacccagcaacaacgagggagatagcatcagtatatgctgcaggagcagaagatgtcgataaagcagtgaatgccgccaaagctgcccttaaggacgattcctggaaactgttgcccgcaacagatagaggtatgctgatgggcagattggctgatttgattgagcagaataaggaattatttgcgacaattgacgcttgggataacggcaaaccataccatgtggcgctatccgaggatttagttgaagcaatcactacatttaggtactacagtggttgggctgacaaaacttttgggcagactataaacactaccccacaaaagttcgcgtataccatcagacaaccaattggcgtggtaggtcaaattataccgtggaattatccattatctatggctgcttggaaactaggtcctgcattagcttgtggcaacaccgtcgttatcaaagcagctgaacagacacctttgagtatattagttttaggaacgcttataaaggaggccggttttcctaaaggcgtcgtgaatattataaacggttatggcagagaagctggtgctgccttggtacaacacccattggttgacaaagtggctttcaccggttctactgctactgcacgtgaaattatgaaaatggccgcaggatcgttgaagaatattacgcttgaaacaggtgggaaatcacctcttatagtgttcaatgatactgacatggaacaagcggttaagtggtcccacttcggtatcatttcgaaccagggccaaatctgtacagctacatctcgtattctagtccagaaggatatatacgacacctttgttgaacagtttaaaggggccatccaaaccacttcaaagattggtgatcaatgggatgaatccacattccaaggtccacaagtaacaagagcccaatatgacagagtcctggaatacattcaagttggaatctcggaaggagccacagttgcgtcaggcggtggaccacatccggccaatagtaacggtgaatctggttattatgtccaaccaaccgtatttactaatgtaaaagatagcatgagaatctacagggaagagattttcggtcctgttgtagtgatagttccgtttgaaacggaggaagaggctatcaggagagctaacgatactacttatggcttgggagcagctgttttcacgaaagatttagaaagagcacatcgtgttgccgccgaaattgagagcggaatggtttggattaattcatctcaagattgcgatccaagagttccctttggtggtgttaagcagtcaggtataggtagagaattaggagaagctgggttagaagcgtattctcaagtcaaagcagtacatgtcaacatgggaaataagttg

SEQ ID NO: 124 - protein, 505 aa, Aspergillus oryzae
MPELDLFLDITAPNGRQYKQPTGLFIDNEFVKSTSGQTIASIDPATTREIASVYAAGAEDVDKAVNAAKAALKDDSWKLLPATDRGMLMGRLADLIEQNKELFATIDAWDNGKPYHVALSEDLVEAITTFRYYSGWADKTFGQTINTTPQKFAYTIRQPIGVVGQIIPWNYPLSMAAWKLGPALACGNTVVIKAAEQTPLSILVLGTLIKEAGFPKGVVNIINGYGREAGAALVQHPLVDKVAFTGSTATAREIMKMAAGSLKNITLETGGKSPLIVFNDTDMEQAVKWSHFGIISNQGQICTATSRILVQKDIYDTFVEQFKGAIQTTSKIGDQWDESTFQGPQVTRAQYDRVLEYIQVGISEGATVASGGGPHPANSNGESGYYVQPTVFTNVKDSMRIYREEIFGPVVVIVPFETEEEAIRRANDTTYGLGAAVFTKDLERAHRVAAEIESGMVWINSSQDCDPRVPFGGVKQSGIGRELGEAGLEAYSQVKAVHVNMGNKL

SEQ ID NO: 125 - DNA, 1581 bp, Zea mays
  CDS (1)..(1581)
atggctatggccatgatggccatgagaagagcagtagctttaggtgcaagacacattccagctgcggctgcttcgtcattcagagttgtgtccttgaggcatatgtccgctgatgctggtgcagctatggagaagattagagctgcaggattactaaggactcaaggtcttattgccggtcaatgggtagatgcgtacgacggtaagacaatagaagtccagaatccagctactggcgaagtcttagccaacgtttcatgcatgggcagtagagaaacatctgatgcgatagctagtgcgcattctactttctactcttggtctaagtttaccgcttccgaaagaagtaaagcccttagaaagtggtatgacttgatcatttcgcacaaagaagaacttgctttgctaatgacgctagaacaaggaaaaccgatgaaggaggcactgggcgaagtcaactatggtgcatccttcatagaatactttgcagaagaagctaaaagaatttacggggatattatccctccaacgttatctgacagacgtctattggtcttgaaacaaccggttggtgtagttggtgctataaccccatggaacttccctttagctatgatcacgaggaaagtaggcccagcattagcctgtggttgtacagttgttgttaaaccgtcagagtttacacctttgacagctcttgcagctgctgatttagcacttcaagctggcataccagctggagcactaaatgtggtcatgggtaatgcggccgagatcggtgatgccttattgcagtcaactcaagtaaggaaaatcacatttacgggttcgactgctgttggcaagaaacttatggccggaagtgcaaacactgtcaagaaggttagcttagagttgggaggtaatgcaccctgcattgtctttgatgatgcagatattgacgtagccgtgaagggttcattagcggctaagtttcgtaactctgggcagacttgtgtatgcgcaaatagaatcctggtccaagaaggtatttatgagaaattcgccaaagccttcattcaagccgttcaaagcctgaaagtgggaaatgggttggaagaatccacctctcaaggtcccttgataaacgaagcagcggttcagaaggtagagaaattcataaacgatgccacatcaaaaggtgctaatgttatgttgggaggcaagcgtcattctctgggaatgagtttctacgaacccacagtagtgggtaatgtgagcaatgacatgctattgtttagagaagaggtctttggtcctgtggccccattgattccatttaagaccgaagaagaagcagttcatatggcaaatgatactaacactggattggcggcatatatctttaccaaatcaattcctagaagttggagggtttccgagtctttagaatatggtttagttggcgttaatgaaggtattatatctaccgaagtggctccttttggcggagttaaacagtcagggttaggaagagaagggagcaaatacgggattgacgaatatttggagttgaaatatatctgtatgggtaatctgggt

SEQ ID NO: 126 - protein, 527 aa, Zea mays
MAMAMMAMRRAVALGARHIPAAAASSFRVVSLRHMSADAGAAMEKIRAAGLLRTQGLIAGQWVDAYDGKTIEVQNPATGEVLANVSCMGSRETSDAIASAHSTFYSWSKFTASERSKALRKWYDLIISHKEELALLMTLEQGKPMKEALGEVNYGASFIEYFAEEAKRIYGDIIPPTLSDRRLLVLKQPVGVVGAITPWNFPLAMITRKVGPALACGCTVVVKPSEFTPLTALAAADLALQAGIPAGALNVVMGNAAEIGDALLQSTQVRKITFTGSTAVGKKLMAGSANTVKKVSLELGGNAPCIVFDDADIDVAVKGSLAAKFRNSGQTCVCANRILVQEGIYEKFAKAFIQAVQSLKVGNGLEESTSQGPLINEAAVQKVEKFINDATSKGANVMLGGKRHSLGMSFYEPTVVGNVSNDMLLFREEVFGPVAPLIPFKTEEEAVHMANDTNTGLAAYIFTKSIPRSWRVSESLEYGLVGVNEGIISTEVAPFGGVKQSGLGREGSKYGIDEYLELKYICMGNLG

SEQ ID NO: 127 - DNA, 1605 bp, Arabidopsis thaliana
  CDS (1)..(1605)
atggcatcaagaagagtttcttcgctgctctctcgctctttcatgtcctcctcacgttctatcttctctcttagaggcatgaacagaggagctcaaagatacagtaacctcgctgctgctgtcgaaaacactattactccaccagtgaaagttgaacacacacagcttctaatcggtggaagattcgttgatgcagtgtcaggaaaaactttccctactttggatccaagaaatggagaagtgattgctcaagtgtctgaaggtgatgcagaagacgtgaaccgcgcggttgcagctgcacgaaaggcttttgatgaaggaccatggcctaaaatgacagcttatgagagatcaaagatactgtttcgtttcgctgatttaatcgagaaacataatgatgagattgctgctcttgagacttgggataatgggaaaccttatgaacaatctgctcaaattgaagtaccaatgcttgctagggtgttccggtactatgctggttgggcagacaagatacatggaatgacaatgccaggagatggtccacaccatgtgcagaccttacatgagcctataggagtcgctggacaaatcatcccatggaacttccctcttctcatgctttcttggaaacttggaccagctttagcttgcggtaacaccgttgttctcaaaactgctgagcaaactcctctatctgctcttcttgttgggaaactacttcatgaggctggacttcctgatggagttgtgaatatagtttctggatttggggctactgctggtgcagctatagctagtcacatggacgttgataaggttgctttcaccgggtctactgatgttgggaagattattcttgagttagcttcaaaaagcaaccttaaggcagtgactcttgagcttggaggaaagtcaccattcattgtatgtgaagatgctgatgtggatcaggccgttgagcttgcacatttcgctttgttctttaaccagggacaatgttgttgtgctggttcgcgtacatttgtacatgaacgtgtgtatgatgagtttgtagagaaagctaaagctcgtgcactcaagcgaaatgttggagatcccttcaagtcaggcattgagcaaggtccccaggtagactcagagcaattcaacaaaatcctgaagtacatcaaacatggagttgaggctggagccacattacaagctggaggtgacaggcttggttccaagggttactacattcaacctactgtcttctcagatgtgaaagatgacatgctcatagcaacagacgagattttcgggccggttcaaaccatactgaaattcaaggatcttgatgaggtgattgcaagggccaacaactcaaggtacggtttagctgctggagtgttcacacagaatcttgacacagcacaccggctgatgcgagcactcagagttgggactgtttggatcaactgttttgatgtacttgatgcatcaattccatttggagggtataagatgagtggcattggtagagagaaaggtatctacagtctcaacaattacttgcaagtcaaggctgttgttacttccctcaagaaccctgcctggctctaa

SEQ ID NO: 128 - protein, 534 aa, Arabidopsis thaliana
MASRRVSSLLSRSFMSSSRSIFSLRGMNRGAQRYSNLAAAVENTITPPVKVEHTQLLIGGRFVDAVSGKTFPTLDPRNGEVIAQVSEGDAEDVNRAVAAARKAFDEGPWPKMTAYERSKILFRFADLIEKHNDEIAALETWDNGKPYEQSAQIEVPMLARVFRYYAGWADKIHGMTMPGDGPHHVQTLHEPIGVAGQIIPWNFPLLMLSWKLGPALACGNTVVLKTAEQTPLSALLVGKLLHEAGLPDGVVNIVSGFGATAGAAIASHMDVDKVAFTGSTDVGKIILELASKSNLKAVTLELGGKSPFIVCEDADVDQAVELAHFALFFNQGQCCCAGSRTFVHERVYDEFVEKAKARALKRNVGDPFKSGIEQGPQVDSEQFNKILKYIKHGVEAGATLQAGGDRLGSKGYYIQPTVFSDVKDDMLIATDEIFGPVQTILKFKDLDEVIARANNSRYGLAAGVFTQNLDTAHRLMRALRVGTVWINCFDVLDASIPFGGYKMSGIGREKGIYSLNNYLQVKAVVTSLKNPAWL

SEQ ID NO: 129 - DNA, 1491 bp, Arabidopsis thaliana
  CDS (1)..(1491)
atggcgattccgatgcctactcgccagctattcatcgacggcgaatggagagaacccatcttgaagaagcgaatcccgatcgttaatccagctactgaagaggtcattgctacaacggaggacgtggatgttgctgtcaacgctgctcgaagagcattatcaaggaataaagggaaagattgggccaaagcacctggagctgttcgtgctaagtatttacgtgctattgctgctaaggtaaatgaaagaaagacggatctggcaaagctcgaggcgcttgattgtggtaaaccattggatgaagcagtatgggatatggatgatgttgctggatgttttgaattttatgctgaccttgctgaaggattagatgctaagcagaaagcaccagtctcgcttcccatggagagttttaagagttatgttctgaagcaacctctcggagttgtgggacttattacaccatggaattacccccttttgatggctgtttggaaggtggctccttcccttgctgcagggtgcactgcgattctcaagccatcagagctggcatcagttacttgtttggagcttgctgatatttgtcgagaagttggtcttcctcctggggtcctcaatgttttgactggtttcggttcggaagctggtgctcctttggcatcacatcctggcgtggacaagattgcatttactggaagtttcgccacaggaagtaaggtcatgacagccgctgctcagttggtgaagcctgtttctatggaacttggtgggaagagccctctcattgtgtttgatgacgttgatcttgataaagctgctgaatgggctcttttcggttgcttctggacaaatggtcaaatctgcagtgcaacttcccgccttcttgttcacgaaagcatcgcatctgagttcatagagaagcttgtaaaatggagcaagaacattaaaatttcagaccccatggaagaaggatgcaggcttggtcctgtagttagcaaaggacagtacgagaagatattgaagtttatctcaacggccaagagtgaaggagcaacgatcttgcatggtggttcccgacctgagcatctggaaaagggcttcttcattgaaccaaccatcataactgatgtaaccacttcaatgcaaatatggagagaagaagttttcgggcctgttctttgcgtgaaaacatttgccagtgaggacgaggcaattgagctagcaaatgactctcattacggactaggagctgcagtgatatctaatgacacagaaagatgtgaccgtataagcgaggcctttgaagctgggattgtctggattaactgctcgcagccttgctttacccaagccccatggggtggtgtcaaacgcagtgggtttggacgagaacttggagaatggggacttgataactacttgagtgtgaagcaagtgactctctacacttcaaacgatccctggggatggtacaaatctcccaactaa

SEQ ID NO: 130 - protein, 496 aa, Arabidopsis thaliana
MAIPMPTRQLFIDGEWREPILKKRIPIVNPATEEVIATTEDVDVAVNAARRALSRNKGKDWAKAPGAVRAKYLRAIAAKVNERKTDLAKLEALDCGKPLDEAVWDMDDVAGCFEFYADLAEGLDAKQKAPVSLPMESFKSYVLKQPLGVVGLITPWNYPLLMAVWKVAPSLAAGCTAILKPSELASVTCLELADICREVGLPPGVLNVLTGFGSEAGAPLASHPGVDKIAFTGSFATGSKVMTAAAQLVKPVSMELGGKSPLIVFDDVDLDKAAEWALFGCFWTNGQICSATSRLLVHESIASEFIEKLVKWSKNIKISDPMEEGCRLGPVVSKGQYEKILKFISTAKSEGATILHGGSRPEHLEKGFFIEPTIITDVTTSMQIWREEVFGPVLCVKTFASEDEAIELANDSHYGLGAAVISNDTERCDRISEAFEAGIVWINCSQPCFTQAPWGGVKRSGFGRELGEWGLDNYLSVKQVTLYTSNDPWGWYKSPN

SEQ ID NO: 131 - DNA, 1587 bp, Arabidopsis thaliana
  CDS (1)..(1587)
atggtaataggagcagcagcgcgtgtagccatcggcggttgtcgaaagctcatctcgtcacatacctccctcctcctcgtctcttctcagtgtcgccagatgagtatggacgcacaaagcgtttctgaaaagcttaggagttctggtctattacgaactcaaggtctaattggaggcaagtggcttgactcgtatgacaataagacaatcaaggttaacaatccagcaaccggtgaaattatagctgatgttgcatgtatgggaacaaaagagacaaatgatgctattgcttcttcttatgaagcatttacttcttggagcagattgactgctggagagaggagtaaagttttacggagatggtatgacctcctgattgcacacaaggaagaacttggacaacttataactttggagcaaggaaaaccactcaaggaagccatcggagaggtagcatatggggcaagttttattgagtactatgcggaggaggcaaaacgtgtatatggtgatataattcctccgaatctgtctgatcgccgactgttggttctaaaacagcctgtcggtgttgttggtgcaattaccccttggaacttccccttagccatgattactcggaaggtcggccctgctcttgcttctggatgcacggtggttgttaaaccatctgaacttacgcccctaacagcacttgctgcggctgaacttgcacttcaagctggagttcctccgggggcacttaatgtggtcatgggaaatgctcctgaaattggggatgctttgcttacgagtccacaggtgagaaaaatcacgttcacgggatcaacagcagttgggaagaagttgatggcagctgctgcacctaccgtcaagaaggtttctctagaacttggcggcaacgcaccctctatagtatttgatgatgcagacctggatgtagctgtaaaaggaacgcttgcagcgaaatttaggaatagtggtcagacatgtgtttgtgcgaacagagtacttgtgcaagatggtatctatgataaatttgctgaggccttttctgaagcggttcaaaaattagaagtaggagatgggtttagggatgggacaacccagggtccacttataaatgatgcagcagtgcaaaaggtagagacatttgtacaagatgctgtttctaagggagcaaaaatcatcattggtggcaaaaggcacagtctagggatgactttctatgagcctactgttatccgcgatgtttcggataacatgatcatgtctaaggaggagatttttggacctgtagctccccttattcggttcaaaaccgaggaggacgctatcagaattgctaatgacacaattgcaggacttgctgcttatatattcacaaacagtgtccaaagatcttggcgtgtatttgaagcacttgaatatggacttgtaggggtgaacgaaggactcatatcaacagaggtggctccattcgggggagtgaagcagtctggtcttggaagggaaggatccaagtatggtatggacgaataccttgagatcaaatacgtatgcttgggagatatgaatagacactga

SEQ ID NO: 132 - protein, 528 aa, Arabidopsis thaliana
MVIGAAARVAIGGCRKLISSHTSLLLVSSQCRQMSMDAQSVSEKLRSSGLLRTQGLIGGKWLDSYDNKTIKVNNPATGEIIADVACMGTKETNDAIASSYEAFTSWSRLTAGERSKVLRRWYDLLIAHKEELGQLITLEQGKPLKEAIGEVAYGASFIEYYAEEAKRVYGDIIPPNLSDRRLLVLKQPVGVVGAITPWNFPLAMITRKVGPALASGCTVVVKPSELTPLTALAAAELALQAGVPPGALNVVMGNAPEIGDALLTSPQVRKITFTGSTAVGKKLMAAAAPTVKKVSLELGGNAPSIVFDDADLDVAVKGTLAAKFRNSGQTCVCANRVLVQDGIYDKFAEAFSEAVQKLEVGDGFRDGTTQGPLINDAAVQKVETFVQDAVSKGAKIIIGGKRHSLGMTFYEPTVIRDVSDNMIMSKEEIFGPVAPLIRFKTEEDAIRIANDTIAGLAAYIFTNSVQRSWRVFEALEYGLVGVNEGLISTEVAPFGGVKQSGLGREGSKYGMDEYLEIKYVCLGDMNRH

SEQ ID NO: 133 - DNA, 1491 bp, Arabidopsis thaliana
  CDS (1)..(1491)
atggccgggactggattgtttgctgagattcttgatggagaagtatacaaatactacgctgatggtgagtggaaaacttcttcctcaggtaagagtgttgccatcatgaacccggccacgaggaagacacagtacaaggttcaagcatgcacgcaagaagaagtgaacgcggtgatggaactggcgaaatcagctcagaaatcgtgggcgaaaactcctctttggaaaagagctgagcttcttcacaaggctgcagcaatccttaaggacaacaaagctcccatggctgagtctcttgttaaagaaatcgctaaacccgccaaagattctgttactgaggttgtgaggtctggagatttgatctcttattgtgctgaagaaggtgttaggatcttaggtgaagggaagtttcttctctccgatagcttccccggtaatgaccgtactaagtactgcctcacttccaagattccactcggtgtggttttggctattcctccattcaattatccagttaatctcgctgtatcgaagatcgctcctgctttgatcgccggaaactcccttgtcctcaaacctccaactcaaggagctgtttcttgccttcacatggtacattgctttcacttagccggtttcccaaaaggtcttatcagctgcatcaccggaaaaggatctgagatcggcgatttcctcactatgcaccctgctgttaactgcattagtttcacgggtggtgataccggaatctcaatctcaaagaaagctggtatgatccctcttcaaatggaacttggaggtaaagatgcatgcattgttctagatgatgctgatcttgatttagttgcttccaatatcatcaaaggaggattctcttacagcgggcagagatgcactgcggttaaggtagtcctagtgatggaatcagtagcggatgagcttgttgagaaagtgaaagctaaagtggccaaactcacggtgggaccgcccgaagagaactccgatatcacggcagtggtgtcggaatcttcagctaatttcattgaaggattggtgatggatgctaaggagaaaggagcaacgttttgtcaagagtataaaagagagggtaacttgatttggccgttgcttttggataatgttagaccggacatgaggatcgcgtgggaggaaccattcggtcctgttgtgccggtcttgaggatcaattctgttgaagaagggattaatcattgcaatgcaagcaactttggccttcagggatgtgtattcactaaagacatcaacaaggcaatactgatcagtgatgcaatggagacaggaaccgttcagatcaactctgcgccagctcgtggaccggaccacttccctttccagggacttaaggacagtggaatagggtcacaaggtgtgacaaatagcatcaatttgatgactaaagtgaagaccactgtcattaacttgcctacaccttcttactctatgggttag

SEQ ID NO: 134 - protein, 496 aa, Arabidopsis thaliana
MAGTGLFAEILDGEVYKYYADGEWKTSSSGKSVAIMNPATRKTQYKVQACTQEEVNAVMELAKSAQKSWAKTPLWKRAELLHKAAAILKDNKAPMAESLVKEIAKPAKDSVTEVVRSGDLISYCAEEGVRILGEGKFLLSDSFPGNDRTKYCLTSKIPLGVVLAIPPFNYPVNLAVSKIAPALIAGNSLVLKPPTQGAVSCLHMVHCFHLAGFPKGLISCITGKGSEIGDFLTMHPAVNCISFTGGDTGISISKKAGMIPLQMELGGKDACIVLDDADLDLVASNIIKGGFSYSGQRCTAVKVVLVMESVADELVEKVKAKVAKLTVGPPEENSDITAVVSESSANFIEGLVMDAKEKGATFCQEYKREGNLIWPLLLDNVRPDMRIAWEEPFGPVVPVLRINSVEEGINHCNASNFGLQGCVFTKDINKAILISDAMETGTVQINSAPARGPDHFPFQGLKDSGIGSQGVTNSINLMTKVKTTVINLPTPSYSMG

SEQ ID NO: 135 - DNA, 1506 bp, Arabidopsis thaliana
  CDS (1)..(1506)
atggagaacggcaaatgcaacggagccacgacggtgaagttaccggagatcaaattcaccaagcttttcatcaacggccagttcattgatgctgcttcagggaagacgtttgagacgatagaccctaggaacggtgaagtgatcgcaacaatagccgaaggagacaaagaagacgttgacttggccgttaacgctgcacgttacgccttcgaccatggtccttggcctcgcatgaccggcttcgagagggcaaagcttatcaacaaattcgcagacttaatagaggaaaacattgaggaattggctaaacttgatgcggttgacggtggaaaattgtttcagttgggaaaatatgctgatattccggccacagccggtcattttcgatacaatgcgggtgcagcagataaaatccacggcgagactcttaaaatgacgcgtcaatctttgttcggatacaccctcaaagaaccaattggagtggttggtaatatcatcccttggaatttcccaagcattatgtttgccacaaaggtggctccggctatggctgctggttgcaccatggtggtcaagccagctgaacagacttcactctctgctttgttctatgcccatctctcaaaagaagcgggaattcctgatggtgtgctcaacattgtaactggttttggatcaactgctggagctgccattgcctcccatatggacgtagacaaagttagtttcactgggtcaacagatgttggaaggaagataatgcaagccgcagccgcaagtaatctcaaaaaagtttcccttgaattaggcgggaaatcgccacttctcatattcaacgacgctgatattgacaaagccgccgatcttgcgcttctcggttgcttttacaacaagggtgaaatttgcgtggcgagctctcgtgtgtttgttcaagaaggtatatacgataaggttgtggagaagttagtagagaaggctaaagattggaccgttggtgatccttttgattccactgctcgacaaggacctcaagtggataaaagacagtttgagaagattctatcttacattgagcacggtaaaaacgaaggagcgaccttattaactggaggaaaagccattggagacaaaggatatttcatccaaccaactatattcgcagatgtcactgaggatatgaagatataccaagatgaaatctttggaccagtcatgtcactgatgaaattcaagacggtagaggaagggatcaaatgcgcaaacaacacgaaatacggtcttgcagcaggaatactaagccaagacatagacttgatcaacacggtttcgaggtcaatcaaagctggaatcatttgggttaattgctacttcgggtttgatcttgactgtccttatggtggctacaagatgagtggtaattgtcgtgaaagtggcatggacgctctcgacaactatctacaaaccaaatccgtcgttatgcctcttcacaattccccttggatgtaa

SEQ ID NO: 136 - protein, 501 aa, Arabidopsis thaliana
MENGKCNGATTVKLPEIKFTKLFINGQFIDAASGKTFETIDPRNGEVIATIAEGDKEDVDLAVNAARYAFDHGPWPRMTGFERAKLINKFADLIEENIEELAKLDAVDGGKLFQLGKYADIPATAGHFRYNAGAADKIHGETLKMTRQSLFGYTLKEPIGVVGNIIPWNFPSIMFATKVAPAMAAGCTMVVKPAEQTSLSALFYAHLSKEAGIPDGVLNIVTGFGSTAGAAIASHMDVDKVSFTGSTDVGRKIMQAAAASNLKKVSLELGGKSPLLIFNDADIDKAADLALLGCFYNKGEICVASSRVFVQEGIYDKVVEKLVEKAKDWTVGDPFDSTARQGPQVDKRQFEKILSYIEHGKNEGATLLTGGKAIGDKGYFIQPTIFADVTEDMKIYQDEIFGPVMSLMKFKTVEEGIKCANNTKYGLAAGILSQDIDLINTVSRSIKAGIIWVNCYFGFDLDCPYGGYKMSGNCRESGMDALDNYLQTKSVVMPLHNSPWM

SEQ ID NO: 137 - DNA, 1617 bp, Arabidopsis thaliana
  CDS (1)..(1617)
atggcggctcgtagagtgtcttctcttttatctcgatctttttcagcttcctctcccttactgtttcgttctcaagggagaaattgttacaatggagggatcttaaggagatttggaacctcttctgctgctgctgaggaaatcataaacccatctgttcaagtttctcacacacagctcctcatcaatgggaactttgttgactctgcttctggtaagacgtttccgactcttgatccgaggacaggcgaagtcattgctcatgtagctgaaggcgatgctgaagatatcaatcgagctgtgaaagctgcaaggacggcctttgatgaaggaccttggcctaaaatgagtgcttatgaaaggtcaagagttttgttgaggtttgcagatttggttgagaaacacagcgaagagctcgcgtctctagagacatgggacaatggcaagccttaccaacaatccttgaccgcagagattcccatgtttgcaagattgttccgttactatgctggatgggcggataagattcatggactaacaattccagctgatggaaactatcaagttcacacattacatgaaccgataggtgtagctggacagatcataccgtggaattttccacttttgatgtttgcttggaaagttggtcctgctcttgcttgtggtaacaccattgtcctcaaaaccgctgagcaaacacctctcacggctttctatgctggaaagcttttccttgaagcgggtcttcctcctggtgttctgaatattgtttcgggattcggtgcaacagcaggtgctgccctcgcgagtcatatggatgtagacaagcttgcttttacaggatcgactgatacggggaaagttatacttggattggctgctaacagcaatcttaagcccgtaactctggaacttggagggaaatcaccgttcatcgtattcgaagatgctgatattgataaagctgtagagcttgcacactttgccctcttcttcaaccaggggcaatgttgctgcgcggggtctcggacatttgttcatgagaaagtgtatgatgagtttgttgagaaatcaaaggcacgcgcattgaaacgtgttgttggtgatcctttcaggaaaggcattgaacagggtcctcagatcgatttgaagcaatttgagaaagtgatgaagtacataaagtcaggtatcgaaagcaatgctactcttgaatgtggtggtgatcagattggagacaaaggttacttcatccaacctactgtcttctctaatgttaaggatgacatgcttatcgctcaagacgagattttcggtccagtccaatcgatcttgaagttcagtgatgtggatgaggtgataaagagggcgaacgagacgaagtacgggctagcggcaggggttttcacgaagaatctggacacggcaaacagggtttcaagggctttgaaagctggtaccgtatgggttaactgcttcgacgtatttgatgcagccataccatttggtggttacaagatgagtgggaatgggagagagaaaggcatatacagtctcaataattacttgcagatcaaggcagtcgtcactgctctaaataagcctgcctggatctga

SEQ ID NO: 138 - protein, 538 aa, Arabidopsis thaliana
MAARRVSSLLSRSFSASSPLLFRSQGRNCYNGGILRRFGTSSAAAEEIINPSVQVSHTQLLINGNFVDSASGKTFPTLDPRTGEVIAHVAEGDAEDINRAVKAARTAFDEGPWPKMSAYERSRVLLRFADLVEKHSEELASLETWDNGKPYQQSLTAEIPMFARLFRYYAGWADKIHGLTIPADGNYQVHTLHEPIGVAGQIIPWNFPLLMFAWKVGPALACGNTIVLKTAEQTPLTAFYAGKLFLEAGLPPGVLNIVSGFGATAGAALASHMDVDKLAFTGSTDTGKVILGLAANSNLKPVTLELGGKSPFIVFEDADIDKAVELAHFALFFNQGQCCCAGSRTFVHEKVYDEFVEKSKARALKRVVGDPFRKGIEQGPQIDLKQFEKVMKYIKSGIESNATLECGGDQIGDKGYFIQPTVFSNVKDDMLIAQDEIFGPVQSILKFSDVDEVIKRANETKYGLAAGVFTKNLDTANRVSRALKAGTVWVNCFDVFDAAIPFGGYKMSGNGREKGIYSLNNYLQIKAVVTALNKPAWI

SEQ ID NO: 139 - DNA, 1527 bp, Arabidopsis thaliana
  CDS (1)..(1527)
atgggttcggcgaacaacgagtacgagtttctgagtgagattgggctgacttctcacaacttgggatcttacgttgctggcaaatggcaagccaacggacctcttgtttcaactctcaatcctgctaacaatcagccaattgctcaagttgtggaagcttctctagaggattacgagcaaggtttgaaagcttgcgaggaagcagctaaaatatggatgcaggttacggctcctaagagaggtgatatcgtcagacagattggggatgcactaagatccaaacttgactatcttggtcgtcttctttctcttgaaatgggaaagatccttgctgaaggtattggagaagttcaggaagtaattgacatgtgtgattttgctgttggtttgagccgacaactcaatggatcggttataccttcagaacgccctaaccacatgatgttggagatgtggaatcctcttggcattgttggtgttatcacagcgtttaattttccctgtgcagttcttggttggaatgcttgtattgctcttgtctgtggaaactgtgtagtctggaaaggtgctccaactacaccgttaataactatcgcaatgaccaagctagtagctgaagttttagagaaaaacaacttacccggtgccatttttacggccatgtgtggtggtgctgaaattggtgaagcaatagccaaagacacacgcattcccttagtatcctttactggaagctccagggtgggctcaatggtacaacaaacagtgaatgcgagatctgggaaaactttgcttgagttgagtggaaacaatgcaatcatagtcatggacgatgctgatatacagttagcggctcgatctgttctattcgctgcggttggaactgctggtcaacgttgcacaacttgccgtaggctgcttttgcatgagagtgtctatgacaaagtactcgagcaactgcttacctcatacaaacaagtcaaaatcggcaatcctcttgagaaagggacattgttaggaccattacatactcctgaatcaaaaaagaactttgagaaaggaattgaagtcatcaaatcccagggtggtaaaatactaacgggaggtaaagcagtcgaaggtgaaggaaactttgtggagcctacgataatcgagatatcagcagatgctgctgtcgtcaaagaagagctatttgctccggttctatatgttctaaagtttaagtcatttggagaggctgttgcgataaacaactcggttcctcaaggtctaagcagctcgatattcactcggaaccctgaaaacatcttcaggtggatcggaccactgggaagtgactgtggcattgtgaatgtgaacataccgacgaatggagctgagattggtggagcttttggaggcgagaaagcgactggtggtggtcgtgaagctggaagcgactcatggaaacagtacatgcgtcgatcgacttgtaccatcaactatggaaacgagttacctctagcgcaaggaattaacttcggttag

SEQ ID NO: 140 - protein, 508 aa, Arabidopsis thaliana
MGSANNEYEFLSEIGLTSHNLGSYVAGKWQANGPLVSTLNPANNQPIAQVVEASLEDYEQGLKACEEAAKIWMQVTAPKRGDIVRQIGDALRSKLDYLGRLLSLEMGKILAEGIGEVQEVIDMCDFAVGLSRQLNGSVIPSERPNHMMLEMWNPLGIVGVITAFNFPCAVLGWNACIALVCGNCVVWKGAPTTPLITIAMTKLVAEVLEKNNLPGAIFTAMCGGAEIGEAIAKDTRIPLVSFTGSSRVGSMVQQTVNARSGKTLLELSGNNAIIVMDDADIQLAARSVLFAAVGTAGQRCTTCRRLLLHESVYDKVLEQLLTSYKQVKIGNPLEKGTLLGPLHTPESKKNFEKGIEVIKSQGGKILTGGKAVEGEGNFVEPTIIEISADAAVVKEELFAPVLYVLKFKSFGEAVAINNSVPQGLSSSIFTRNPENIFRWIGPLGSDCGIVNVNIPTNGAEIGGAFGGEKATGGGREAGSDSWKQYMRRSTCTINYGNELPLAQGINFG

SEQ ID NO: 141 - DNA, 1563 bp, Drosophila melanogaster
  CDS (1)..(1563)
atgctgcgcgttttgaagaccggtgccctgctgcgttcccaggccaagaacttcgcagcagctgttgcgaactactcctccctcccgcagccacagacaacgcccgatatcctctacaccggggtatttatcaacaacgagtggcacaagagcaagtcgggcaaaatatttgaaaccatcaacccgaccacagcggaagtcattgccgaaattcagtgtgctgataaggaagatatcgatattgccgtccaggctgcacgcaatgcattcaagttgggatctccatggcgtcgcatggatgcctcggagcggggtcgcctgctctaccgcctggctgatctcatggaacgcgatcaggtctatcttgccagtctggagacccttgacaacggcaagccctacagcatgtcctacaacgtggatctcccgactgccatcaagaacctgcgctactttgctggatgggcggacaagaaccatggcaagactattcccatggacggagatttcttcacttacacccgccatgaacccgtgggcgtgtgcggccagatcattccctggaacttccccatcctgatgatggcctggaaactgggtcccgctttggctaccggcaacaccattgtactaaagcccgctgagcagaccagtttgactgctctgtacattgcccagttggtgaaggaggctggcttccccgaaggtgtggtcaatgtggttcccggatttggaactgctggcgctgccttggcgaaccactgcgatgtggataaggtggccttcaccggttccaccgatgtgggcaaacttatccaactagcatcgggaaatactaacctaaagagagtgacactggagttgggaggcaagtcgccaaacattattctgtctgacaccgatatggactacgccgtcgagacggctcactttggtctgttctttaacatgggccagtgctgctgtgcaggatctcgtactttcgtggaggacaagatctacgatgagtttgtcgagcgcagcgcggagcgggctaagaagcgcaccgtgggcaatccctttgatctgaacactgagcaaggtcctcaggtgaacgaggagcagatggaaaagatccttggaatgatcaaaacaggcaagaaacagggcgctaagttggttgccggtggcagtcgcccagagggcctacccggctacttcgtccagcccacggtgttcgccgatgtccaggatgatatgaccattgcaagggaggagatctttggaccggttcagcagctgatccgcttcaagaagctggatgaggtcatcgagcgggctaacaactccgagtacggattggccgccgccgttttcaccaaggatctggacaaggccaactacattgtgggtggcctgcgtgccggaactgtgtgggtaaacacctacaatgtcctcgctgcccaggctccgttcggtggctacaagatgtccggccatggacgcgagaacggagagtatgctctgtccaactacacggaggtcaagagcgtcatcgtcaaggttgcccagaagaactcctaa

SEQ ID NO: 142 - protein, 520 aa, Drosophila melanogaster
MLRVLKTGALLRSQAKNFAAAVANYSSLPQPQTTPDILYTGVFINNEWHKSKSGKIFETINPTTAEVIAEIQCADKEDIDIAVQAARNAFKLGSPWRRMDASERGRLLYRLADLMERDQVYLASLETLDNGKPYSMSYNVDLPTAIKNLRYFAGWADKNHGKTIPMDGDFFTYTRHEPVGVCGQIIPWNFPILMMAWKLGPALATGNTIVLKPAEQTSLTALYIAQLVKEAGFPEGVVNVVPGFGTAGAALANHCDVDKVAFTGSTDVGKLIQLASGNTNLKRVTLELGGKSPNIILSDTDMDYAVETAHFGLFFNMGQCCCAGSRTFVEDKIYDEFVERSAERAKKRTVGNPFDLNTEQGPQVNEEQMEKILGMIKTGKKQGAKLVAGGSRPEGLPGYFVQPTVFADVQDDMTIAREEIFGPVQQLIRFKKLDEVIERANNSEYGLAAAVFTKDLDKANYIVGGLRAGTVWVNTYNVLAAQAPFGGYKMSGHGRENGEYALSNYTEVKSVIVKVAQKNS

SEQ ID NO: 143 - DNA, 1725 bp, Drosophila melanogaster
  CDS (1)..(1725)
atgttgcgaatgatgcgaagttcctcctccagatgctctagtcttcagcagagcttgttgaaaagttcgacacgctgtctgggttccgttataccggaccttaaactgaaggacttcccgatcgccaatgagccaatcctgggatatctcaaggactctaaggagcgtaaggccctcgagcaggctctaaagggcacggcctcgagttgcgaagacatccccatcgtgatcggcggcaaggagtacaagacgccggaggttcgataccaggtcatgccccatgaccaccaacacaagctggccagcttctactacgccgacaagaagcttatcgagaaggccatcaaaacggcggtggaaacacagcccaagtgggaccgtgtgtcgattgcagaccgtctgaagatctgggagaaggcagcggacctaatggcaacgacgtaccgccaggatctcaacgccgccaccatgctgggtcagtcaaagacggcgattcaggcggaaatcgattcagcagcggagcttatcgactttatacgaatgaatgcctattttctgaaggaggtcactaaataccagcccatcagcgagaacataaaggtcacgaagaactccttgcgctatcgtggcattgatggcttcatcgccgctgtcagcccctttaactttacggccatcggcggcaacttgtcctacacgccagctctgatgggaaacggcgtgctgtggaagccctcggacactgccatgctgtccaactggattattttcaagattatgcgcgaagcgggagtgcccgatggagtcgttaactttgtgcccgccgatgggcccgtgtttggagacacgattacggccagtccccacctggcaggcatcaatttcaccggctctgtgccaacctttaaccgcctgtggaagcaggtgggcaacaacattgacaactacgtgaactttcctcgcttgactggtgagtgtggcggcaagaatttccactttatacatgcatcagccgacgttgagtcagtggtgacctccacgatacgctcagcatttgagtactgcggccagaagtgttccgcctgctcgcgaatgtatgtgccggaatccctttggccacagatcaaggagggcctggtatgcgaggcagcaaagctgaagatcggtgacgttcaagacttcagcagcttcacgtcggctgtgattgatgacaaagcatttaaacgcattacgggctacattgagcatgccaaaaaatccccgaacctcgagattctcgccggaggcacttactcagacagcaagggctacttcgttaatccgaccattgtactcagcaaggatcccaaggaccggatcatgaccgaagagattttcggtcccgtgctatctatttatgtgtacaaggagtcggacctccttgagaccatgaaactggtgcacacctctaccaagtttgctttaaccggagcagtattcgggcaggacgaggatttcgtcaagtgcgctctgcaggagtttaaaatggccgctggaaacttctacatcaacgacaagtccactggatccgtggtgggccagcagccattcggaggcggccggatgtccggcaccaatgacaaggccggaggaccacattatattctgcgctggacctctccgcagtccatcaaggagacctttgtgccgctgcgggacgtcaactatccatacatgtgcgagtaa

SEQ ID NO: 144 - protein, 574 aa, Drosophila melanogaster
MLRMMRSSSSRCSSLQQSLLKSSTRCLGSVIPDLKLKDFPIANEPILGYLKDSKERKALEQALKGTASSCEDIPIVIGGKEYKTPEVRYQVMPHDHQHKLASFYYADKKLIEKAIKTAVETQPKWDRVSIADRLKIWEKAADLMATTYRQDLNAATMLGQSKTAIQAEIDSAAELIDFIRMNAYFLKEVTKYQPISENIKVTKNSLRYRGIDGFIAAVSPFNFTAIGGNLSYTPALMGNGVLWKPSDTAMLSNWIIFKIMREAGVPDGVVNFVPADGPVFGDTITASPHLAGINFTGSVPTFNRLWKQVGNNIDNYVNFPRLTGECGGKNFHFIHASADVESVVTSTIRSAFEYCGQKCSACSRMYVPESLWPQIKEGLVCEAAKLKIGDVQDFSSFTSAVIDDKAFKRITGYIEHAKKSPNLEILAGGTYSDSKGYFVNPTIVLSKDPKDRIMTEEIFGPVLSIYVYKESDLLETMKLVHTSTKFALTGAVFGQDEDFVKCALQEFKMAAGNFYINDKSTGSVVGQQPFGGGRMSGTNDKAGGPHYILRWTSPQSIKETFVPLRDVNYPYMCE

SEQ ID NO: 145 - DNA, 2742 bp, Drosophila melanogaster
  CDS (1)..(2742)
atggctctaaaaatgagaatcgcaattataggacagagcaattttgctgctgatgttctggagcttctgttggatcgctcaaatatccaaattgtaggagtcttcactattccagataaaggcagtcgagaggatattttggctactactgctaccatccacaatatacctgtttttaagttcgcatgctggcgtcgcaagggcgtggcactacctgaggtcttggaacaatacaagtccgtgggggctaccctgaatgtgttgcccttctgttctcaattcattcccatggaggtgattaacggggcgctattgggcagcatttgttaccacccttctatcctcccacgtcaccgcggagcgagtgccatatcgtggacactgatcgagggggacgaggtggccggcttcagcatcttttgggcagatgacggtcttgacacaggacccctactgctaacccgacaaacaaacgtggaatccacggacactctggacaccatatacaagcgctttttgtaccccgaaggtgtgaaggcgatgggcgtcgccgtggacatggtggctagtggtacagctcccaagataattcagccggaagtgggggcaacctacgacccggctatgtttaaaacagaaaatcaggttatcaatcttcaggctacagcagaaaaaatttggaactttgttcgtggtctggactcagttcctggagccatagcaacggttctgcacgggaatggcacagaggagcaaattcgactctttggtgctcatttgtactctgctggccccgtgtcgaatggaaaggttcttcgtctaagaggcttaacaaagaccgcctggatacacagcggtggtcttcttatagagggaacagacggtgcctttgtcaacattcgccgcattaagcgtggcacaaaggtaatcagtgccagcgagtggtttaagcaagctgaggaccagtctatcactgacttcagcgaggacgaattggtaaagcgatcgttgctggctggaatttggaaggcaatacttaaggaagatgtcgagtcatcgactgatttctttgcatccggagctggttcaatggacgtggtgcgcttagtcgaggaagttaaagaagcctttgacgtgcccctgcagaacgagcaagttttcatggcgcctgtgtttgaagagttctttagcctgctggttaggttccttcgacagggaagtgccggtttcggtaaccagcagctcgattttgaggcattcacgctgaaagccaacaaaagagagattcgagtgcccacacaactttttatcaacggagagtttgttgacgccgaggctcaacgcactttggaaattgtaaaccctactaatgaggaagtgctttgcaaagtggcatgcgcttcggccaccgacgtggacaaggcagtgcgagcagcgcattctgccttttatggatcttggaggcaaataacacccagacaacgaggccagttgatgctgaacttggctgatctgatggaacgaaataaggaggagctggccacaattgagtcagtcgattcgggagcggtttacacgctagcccttaaaacccatgttggaatgtccatcgaagcgtggcgctactttgccggatggtgcgacaagatccagggcaacacaatccctgttaaccctgcgagacccaacaacgtactgaccttcacccgtaaggagccaattggtgtatgcggtttaataacgccttggaactaccccctgatgatgctttcctggaaaatggccgcctgcattgccgccgggaatacctgtctcataaagcctgctcagacctgtcccctgaccgctctaaagtttgcagagctaactgtccgagccggattcccccccggcgttatcaatgtcctgcctggaaaaggttcagatgcaggccaggcagtggcagaccatgagctggtccgcaaactggggtttaccgggtccacacccattggcaagcacattatgaagtcatgcgcagactccaaccttaaaaagtgctccctagagctgggcggcaagagcccgctaattatctttgcagattgtgatatggacaaagccgtcaaacacggcatgtcctcggtgttttttaataaaggagagaactgcatcgccgctggacggcttttcgtggaggatcggatacacgacgaatttatccgacgcgtccttaaggatttgcgcaccatgacaatcggggacccacttgaccgctcgacggcccacgggcctcagaaccacaaggcgcactttgacaaactgctggagttttgtagacgtggggtcgacgagggcgcaaagctggtgtacggaggatgtcgagtcccaaacctcaagggatattttttcactcccacagtgtttacgaacgttacggacgatatgtttattgcccaagaggagtcctttggaccgatcatgataatatccaagttcaatggcagcgacatagattcattgatgcagcgagctaatcgcacagagtatggcctggccagtggcgtttttacaaaggatattggcaaagcgcttaactttgcggatcgcatcgaggccggcactgtgttcgtcaatgtatataataagactgatgtggctgctccatttgggggctttaagcagagcggttatggcaaggacttgggtcaggaggcgcttaacgagtatcttaagaccaagtgtgtcacagttgaatattag

SEQ ID NO: 146 - protein, 913 aa, Drosophila melanogaster
MALKMRIAIIGQSNFAADVLELLLDRSNIQIVGVFTIPDKGSREDILATTATIHNIPVFKFACWRRKGVALPEVLEQYKSVGATLNVLPFCSQFIPMEVINGALLGSICYHPSILPRHRGASAISWTLIEGDEVAGFSIFWADDGLDTGPLLLTRQTNVESTDTLDTIYKRFLYPEGVKAMGVAVDMVASGTAPKIIQPEVGATYDPAMFKTENQVINLQATAEKIWNFVRGLDSVPGAIATVLHGNGTEEQIRLFGAHLYSAGPVSNGKVLRLRGLTKTAWIHSGGLLIEGTDGAFVNIRRIKRGTKVISASEWFKQAEDQSITDFSEDELVKRSLLAGIWKAILKEDVESSTDFFASGAGSMDVVRLVEEVKEAFDVPLQNEQVFMAPVFEEFFSLLVRFLRQGSAGFGNQQLDFEAFTLKANKREIRVPTQLFINGEFVDAEAQRTLEIVNPTNEEVLCKVACASATDVDKAVRAAHSAFYGSWRQITPRQRGQLMLNLADLMERNKEELATIESVDSGAVYTLALKTHVGMSIEAWRYFAGWCDKIQGNTIPVNPARPNNVLTFTRKEPIGVCGLITPWNYPLMMLSWKMAACIAAGNTCLIKPAQTCPLTALKFAELTVRAGFPPGVINVLPGKGSDAGQAVADHELVRKLGFTGSTPIGKHIMKSCADSNLKKCSLELGGKSPLIIFADCDMDKAVKHGMSSVFFNKGENCIAAGRLFVEDRIHDEFIRRVLKDLRTMTIGDPLDRSTAHGPQNHKAHFDKLLEFCRRGVDEGAKLVYGGCRVPNLKGYFFTPTVFTNVTDDMFIAQEESFGPIMIISKFNGSDIDSLMQRANRTEYGLASGVFTKDIGKALNFADRIEAGTVFVNVYNKTDVAAPFGGFKQSGYGKDLGQEALNEYLKTKCVTVEY

SEQ ID NO: 147 - DNA, 1014 bp, Drosophila melanogaster
  CDS (1)..(1014)
atgtttgacaacgcgattaaacctcatccggaggccaatggagctccaataaatgcaggagatcggccgataactactgtcattaatattgaaccagaaccagaaaccgaaagtccaattgggatcttcacatcacaaccggaaagtcaacaacaacaacccgagcagctccaatccgaatccgagtccgacagaatggccaattttgacgatacgttgcaacgcgcccgccttgccttttccagtggaaagaccaggaatgtcagctttcgacgcaagcagctggagaatttgctgcgttgctatgaggagcacgagaacgagatcatcagcgccttggaggcggatctgcgacgtcccaagcaggagagcctcatcgtggaaacggaattcatgaagaacgacatcaggcacatcctattccagctcgacgagtgggtgcagtcggagaagccgcccaagtcgtttgtgaacatgatggacgacgtccagatctacaatgaccccttcggagtggttctggtgatcggcgcctggaactacccgctgcagctgctgctcgtgccagtggcttccgccatcgccgccggaaactgtgtggtgatcaagcccagcgagattgccgccaactgcgccaagttcattgccgatgtcattccaaaatatttggataatgattgctatccagttgtctgcggtggacccagcgaaacggcggagctgctcaaccagcgtttcgactacatcttctacacgggctccacgcgcgtaggcaagattatccacgccgcggccaacaagtacttgacccccaccaccttggagctgggtggcaaaagcccctgctacattgacaaatctgtggacatgcgcactgcggtcaagcgcatcctgtggggcaagctgattaactgcggacagacctgcatcgctccggactacatcctctgctccaaggaggtaactacgatgccagcgagcgtttcatcgaacccaccatcttggtggacgtga

SEQ ID NO: 148 - protein, 337 aa, Drosophila melanogaster
MFDNAIKPHPEANGAPINAGDRPITTVINIEPEPETESPIGIFTSQPESQQQQPEQLQSESESDRMANFDDTLQRARLAFSSGKTRNVSFRRKQLENLLRCYEEHENEIISALEADLRRPKQESLIVETEFMKNDIRHILFQLDEWVQSEKPPKSFVNMMDDVQIYNDPFGVVLVIGAWNYPLQLLLVPVASAIAAGNCVVIKPSEIAANCAKFIADVIPKYLDNDCYPVVCGGPSETAELLNQRFDYIFYTGSTRVGKIIHAAANKYLTPTTLELGGKSPCYIDKSVDMRTAVKRILWGKLINCGQTCIAPDYILCSKEVTTMPASVSSNPPSWWT

SEQ ID NO: 149 - DNA, 1527 bp, Drosophila melanogaster
  CDS (1)..(1527)
atgatgaacaaattgcaaaaactactggcacaccaattggctgtttcacgaaagtggtcgaaatttgatcatacttatgcccagtgcgaacccaattactgtcagcttttcatcaacaatgagttcgttgattcggtgtcgggcaagacctttgccaccttcaatccggctacatccaaggagattgtccaagtctccgagggagataaggctgatatcgacctggctgtgaaagcggccaagaaagccttccatcgcgactcggaatggcgcaaattgagtcctctgcagcgcaccaatttgatgaacaaactttgtgccctgatggatcgggacaaggcattcctggccagcttggagacccaggacaatggaaagccctacgctgaggccctcttcgatgtgacctactcgatcctgacgctgcagtactacgccggctggaccgacaagttcttcggcgacaccattcccgctggaggctttgtctccatgacccgcaaggaaccggtgggcgtggtgggccagatcataccctggaactatcccctgctgatgctggcctggaagtggggccccgctctggccgtcggatgcaccatcatcatgaaacccgcggagcaaactcctctgactgcccttcacatggctgctttggcgaaggaggcaggcttcccagccggtgtgatcaatgtggtcaacggatttggtcccactgccggtgctgctatcagtgctcatcctgatattgccaaggtggctttcaccggctccgtggaaatcggtcggattgtcatgcaggctgcagccacgtcgaacttgaagagggtctccctggaattgggcggcaagagccccgttgtggtcttcgatgatgcggacattgacttcgccgtggaaaccacccacgaggctctgttctccaatcacggccagagctgctgtgccggcagtcgcacctacgttcacgaaaagatctacgacgagttcgtggccaaggcagctgccaaggcaaaggcccgcaaggtgggcaatcctttcgagcagaatgtgcagcagggtccccagatcgacgatgacatgctgaccaaggtgttgggctacatcgagagtggcaagaaggagggtgccaagttgcaggctggtggcaagaggatcggcaatgtcggtttcttcgttgagcccactgtcttctcggacgtgaaggatgatatgcggattgcccaggaggagatctttggccccgttcagtcgatcttcaagttcagctccctggaggagatgatcgatcgggccaacaatgtgcaatatggcctggccgccggcgttattaccaatgacatcaacaaggcactgaaattcgccaacaatgtggatgccggctccgtgtggatcaactgctatgatgccgtgctgccctccaccccgttcggtggatacaagcactctggcattggcagggaattgggcaaggatggcctggataactatctggaaaccaagaccatcaccatgaaacttctttaa

SEQ ID NO: 150 - protein, 508 aa, Drosophila melanogaster
MMNKLQKLLAHQLAVSRKWSKFDHTYAQCEPNYCQLFINNEFVDSVSGKTFATFNPATSKEIVQVSEGDKADIDLAVKAAKKAFHRDSEWRKLSPLQRTNLMNKLCALMDRDKAFLASLETQDNGKPYAEALFDVTYSILTLQYYAGWTDKFFGDTIPAGGFVSMTRKEPVGVVGQIIPWNYPLLMLAWKWGPALAVGCTIIMKPAEQTPLTALHMAALAKEAGFPAGVINVVNGFGPTAGAAISAHPDIAKVAFTGSVEIGRIVMQAAATSNLKRVSLELGGKSPVVVFDDADIDFAVETTHEALFSNHGQSCCAGSRTYVHEKIYDEFVAKAAAKAKARKVGNPFEQNVQQGPQIDDDMLTKVLGYIESGKKEGAKLQAGGKRIGNVGFFVEPTVFSDVKDDMRIAQEEIFGPVQSIFKFSSLEEMIDRANNVQYGLAAGVITNDINKALKFANNVDAGSVWINCYDAVLPSTPFGGYKHSGIGRELGKDGLDNYLETKTITMKLL

SEQ ID NO: 151 - DNA, 1530 bp, Drosophila melanogaster
  CDS (1)..(1530)
atgtggcgacagctcagcggagtcgcacgaacaggaagcagcctaagcctctgcagaatgcgaggattctcggcactggtgcaggataaggccctggtggatggcgcctgggtggattccagcaatgcaaaggcgaccttcgaggtgcggaatcctgccaatggtgctgtcatcggcaaagtgcccaacatgacggtggcggatgcccagaaggccatagacgccgctaagcaggcgtacgagtccaaggagtggcgatccctgaccgccaaggatcggtccaacctgctcaagaagtggcacaaactgatcgagcagcactcgcaggagatagccgagataatgacggccgagtcgggcaagccgatcaacgagtcgaagggggaggtggcctacggaaacgccttcgtcgagtggtttgcagaggaggcccgtcgcatctacggcgaaattgtgcccagtgcatcgcccaatcgcgaaatcatagtaatgaagcagcccattggggtggcggcgctgattacgccctggaacttcccgatggctatgattacgaggaaagcaggagccgccctggccgcaggatgtacggtcgtggtgaaaccttcagaagacactcctcttactgccctggctgtggccaaattggcagtggacgctggcattccaaagggtgtgataaatgtggtcaccacaaacaaagcggctcccattggcgatctcttctgcaagagtcccgatgttaggggtatatccttcacgggctccactgaggtgggcaaactgctgttccggaactctgctgatggcatcaaaaggatttgtctcgagctcggcggcaatgctccgttcattgtcttcgattcggcggacattgaaaaagcagtggatggcgccatggcctcgaagtttaggaattgcggacagacctgcgtctccgccaatagattctttgtccaggacagcgtctacgataagtttgttgggcagctgaaaaaacgcgtggaagctttgaagatcggagatggtcagggttgcgatgtgcaaatcggaccactgatcaacgagatgcagttcaacaaagtcagtggctttgtggaggacgccaggtcgaagaaggcgaacattattctgggcggacagccgttgcccgacaagggatcccttttctacgcacccacaattgtcacagatgtgccaccctcggcgcaactctactcggaggaggtctttggtccagtggtctccatcatacggttccgagacgaagaagaagcggtaaagaaggcaaacgacaccaggagaggcctggccggttacttctacagcgagaatctgcagcaggtgttccgggtggccaagcgactggaggttggcatggtcggcgtcaacgaaggcatcatctccgcagcagaggctccgtttggtggcgtcaaggagtccggtgtcggacgggagggttccaaacacggtatcgacgactatgtggacatcaagtacatttgcatgggcaacctcaagtacgactga

SEQ ID NO: 152 - protein, 509 aa, Drosophila melanogaster
MWRQLSGVARTGSSLSLCRMRGFSALVQDKALVDGAWVDSSNAKATFEVRNPANGAVIGKVPNMTVADAQKAIDAAKQAYESKEWRSLTAKDRSNLLKKWHKLIEQHSQEIAEIMTAESGKPINESKGEVAYGNAFVEWFAEEARRIYGEIVPSASPNREIIVMKQPIGVAALITPWNFPMAMITRKAGAALAAGCTVVVKPSEDTPLTALAVAKLAVDAGIPKGVINVVTTNKAAPIGDLFCKSPDVRGISFTGSTEVGKLLFRNSADGIKRICLELGGNAPFIVFDSADIEKAVDGAMASKFRNCGQTCVSANRFFVQDSVYDKFVGQLKKRVEALKIGDGQGCDVQIGPLINEMQFNKVSGFVEDARSKKANIILGGQPLPDKGSLFYAPTIVTDVPPSAQLYSEEVFGPVVSIIRFRDEEEAVKKANDTRRGLAGYFYSENLQQVFRVAKRLEVGMVGVNEGIISAAEAPFGGVKESGVGREGSKHGIDDYVDIKYICMGNLKYD

SEQ ID NO: 153 - DNA, 1623 bp, Drosophila melanogaster
  CDS (1)..(1623)
atgttggcacaattgagaaatatttcgaagctggcgctgccgcgccgcctcgttacccaaaccgccagctactcatcgtcctcgtcatatctcattgaccagccggagtacagtttcctgaaagaattgggactggagcgcgacaatccaggtgtttattcgggtcagtggcagggtcgtgggccatccgttaccagctacgatcccggaactggtcaaccgattgccaaagtgcgtcagggaaatgtccaggagctcgagcataccatcgggctggcggtggaagcctacaagcagtggcgacaggttccagctcccgttcgcggcgaaatagtgcgccaaatcggcgatgagctgagaaagtacaaggaaccactgggaaagctcgtctccctggaggtgggcaaaatctacagcgagggacagggcgaggttcaggagttcatagatatctgcgactatgcggttggcctctcaaggatttactccggccagctgatcaactcggagcgtgcggatcattcgattctggaggcctggcgtccgctgggagtggtgggcgttatttcggcctacaattttcccaatgctgtgttcggctggaatgctgccatcgccctaaccaccggcaacagtgtgctgtggaaaggagctcccagcactcccttggtctcggtggcgaccacaaaaattgtggctgaagtgctgcgtaggaacaatctgccgccggtggtgaccctctgccaaggaggaaccgatgttggtcagaccttggtggctgataagagagttaacctcgtttccttcaccggcagctgccaaactggtcgggatgtgggtgttgaagtgcagcgcagattcggcaaggtgatcctcgagctaggcggcaataatgccctaatcatcgatgaatctgccaacgtgaagatggccctggacgccgcacttttcggctgcattggcaccagtggtcaaagatgcaccaccaccaggaggattattgtccacgaaaagctgcacgatcagttcgtaaaggagctggttggtaaatataagcagctaatttccaagattggacaccagctcgaagctcaaactctggtgggtcccgtgcacacgcaacaaaacgtggagaactacaaggcggccatcgcggaagcgaaatccttaggaggaacggtggccttcggaggtaatgtcatccagcgggatggtttttacgtagagcccacagtgatcactggattgccgcacgatgccagcgttgtccatcgcgaaacctttgcaccaattgtgtacatcctcaaagccaaaaacgtggaccaggccatcgaatggaacaatgaggtggaacagggcttatcctctgccattttcacggagaacatcgggcaggcgttcaagtggattggagccaagggttccgattgcggtatagttaacatcaacaccaccaccaacggcgccgagattggtggagctttcggaggcgaaaaagccactggaggaggtcgcgagtccggatccgatgcctggaagcagtattgcaagcgggccaccattacagtcaatcactccggagaattggcctgcgcccagggtgttgtcttcaatgtggagtag

SEQ ID NO: 154 - protein, 540 aa, Drosophila melanogaster
MLAQLRNISKLALPRRLVTQTASYSSSSSYLIDQPEYSFLKELGLERDNPGVYSGQWQGRGPSVTSYDPGTGQPIAKVRQGNVQELEHTIGLAVEAYKQWRQVPAPVRGEIVRQIGDELRKYKEPLGKLVSLEVGKIYSEGQGEVQEFIDICDYAVGLSRIYSGQLINSERADHSILEAWRPLGVVGVISAYNFPNAVFGWNAAIALTTGNSVLWKGAPSTPLVSVATTKIVAEVLRRNNLPPVVTLCQGGTDVGQTLVADKRVNLVSFTGSCQTGRDVGVEVQRRFGKVILELGGNNALIIDESANVKMALDAALFGCIGTSGQRCTTTRRIIVHEKLHDQFVKELVGKYKQLISKIGHQLEAQTLVGPVHTQQNVENYKAAIAEAKSLGGTVAFGGNVIQRDGFYVEPTVITGLPHDASVVHRETFAPIVYILKAKNVDQAIEWNNEVEQGLSSAIFTENIGQAFKWIGAKGSDCGIVNINTTTNGAEIGGAFGGEKATGGGRESGSDAWKQYCKRATITVNHSGELACAQGVVFNVE

SEQ ID NO: 155 - DNA, 1506 bp, Rattus norvegicus
  CDS (1)..(1506)
atgtcttcccctgcacagcctgcagttcctgccccactggccaacttgaagattcaacacaccaagatcttcataaacaatgaatggcatgattcagtgagtggcaagaaatttcctgtccttaaccctgcaactgaggaggtcatctgccatgtggaagaaggggacaaggcagatgttgacaaagctgtgaaggccgcaagacaggctttccagattggctccccatggcgcaccatggatgcttcagagagaggacgcttgctgaacaagctggctgacttaatggagagagatcgtctgctgctggctacaatagaggccatcaatggtgggaaagtctttgccaatgcgtacttgtcggatttaggaggcagcataaaagcattaaagtactgtgcaggctgggctgacaagatccatggtcaaacaataccgagtgatggagacattttcacttttacgagacgtgaacctattggggtgtgtggccaaatcatcccttggaattttccactgcttatgttcatttggaagataggccctgccctcagctgtgggaacacggtggtcgtcaagccagcagagcaaactcctctcactgctcttcacatggcatctttaataaaagaggcagggtttcctcctggcgtggtgaacattgtccctggttatgggccaactgcgggggcagcgatctcctctcacatggatgtggacaaggtggccttcacgggatcaacccaggttggcaaattaatcaaggaagctgcaggaaaaagcaatctgaagagggtcacgctggagcttgggggaaagagcccttgcattgtgtttgcagatgccgacttggacattgctgtcgagtttgcacaccatggagtcttctaccatcaaggccaatgctgcgtcgcggcatcccggattttcgttgaggagtcagtttatgatgagtttgtgagaaagagtgttgagcgagccaagaaatatgtccttggaaaccctctgacccaaggaataaatcagggccctcagattgacaaggagcaacatgataaaatccttgatctcattgagagtgggaagaaagaaggagccaaactggagtgtggtggaggacgctgggggaacaaaggcttctttgtccagcccacagtcttctccaatgtgaccgatgagatgcgcattgccaaagaggagatatttggaccagtgcaacaaatcatgaagtttaagtccatagatgatgtgatcaagagagcaaacaatactacctatggtctagcagcaggagtcttcacaaaagacctggacagggccatcactgtgtcttctgctctgcaggccggggtagtgtgggttaactgctatatgatcttgtcagcccagtgccccttcggtggattcaagatgtctggaaatggacgagaactgggtgaacatggtctttatgagtacactgagctcaagacagttgcaatgaaaatatctcagaagaactcctaa

SEQ ID NO: 156 - protein, 501 aa, Rattus norvegicus
MSSPAQPAVPAPLANLKIQHTKIFINNEWHDSVSGKKFPVLNPATEEVICHVEEGDKADVDKAVKAARQAFQIGSPWRTMDASERGRLLNKLADLMERDRLLLATIEAINGGKVFANAYLSDLGGSIKALKYCAGWADKIHGQTIPSDGDIFTFTRREPIGVCGQIIPWNFPLLMFIWKIGPALSCGNTVVVKPAEQTPLTALHMASLIKEAGFPPGVVNIVPGYGPTAGAAISSHMDVDKVAFTGSTQVGKLIKEAAGKSNLKRVTLELGGKSPCIVFADADLDIAVEFAHHGVFYHQGQCCVAASRIFVEESVYDEFVRKSVERAKKYVLGNPLTQGINQGPQIDKEQHDKILDLIESGKKEGAKLECGGGRWGNKGFFVQPTVFSNVTDEMRIAKEEIFGPVQQIMKFKSIDDVIKRANNTTYGLAAGVFTKDLDRAITVSSALQAGVVWVNCYMILSAQCPFGGFKMSGNGRELGEHGLYEYTELKTVAMKISQKNS

SEQ ID NO: 157 - DNA, 1689 bp, Rattus norvegicus
  CDS (1)..(1689)
atgctgccgccggctttgcttcgccgatccctgctgtcctacgcctggaggggctctgggctgcggtggaaacatgcctcctctctgaaggtggccaatgagcccatcttagcgtttactcagggcagccccgaacgggacgcactgcagaaggctctgaacgacctgaaggaccagacagaagccatcccctgcgttgttggggacgaggaggtgtggacctctgatgtgcggtaccagctgtcgccttttaaccatggacacaaggtggccaagttctgttatgccgacaaggccttgctcaacaaagccatcgaagctgccgtgcttgccaggaaagagtgggacctgaagcccgtggcagaccgggcccagatcttcctgaaggcggcagatatgctgagcgggccccgaagggctgaaatccttgccaagaccatggtgggacagggcaagaccgtaatccaagcagagattgacgccgcagccgaactcatcgacttcttcaggttcaatgccaagttcgccgtggaactggagggggaacaacccatcagcgtgccacccagtaccaaccacgtggtgtaccggggactggagggcttcgtggcggccatctctcccttcaacttcaccgcgatcggaggcaacctggcaggcgcaccggccttaatgggcaacgtggttctctggaagcccagtgacactgccatgttggctagctatgctgtctaccgcatcctccgggaggccggcttgccccccaacgtaatccagtttgtgccagctgatgggccgacattcggggacacagtcaccagctcagagcacctctgtggtatcaacttcacaggcagtgtgcccacctttaaacacctgtggaagcaggtggcccagaatctggaccggttccgtaccttcccacgcctggctggagagtgtggcgggaagaatttccatttcgtgcacagctcggccgacgtggacagcgtggtgagcgggacgctgcgctcggccttcgagtatggcggtcagaagtgctcagcctgctcgcgcctctacgtgccacagtctctgtggccacagatcaaagggcgactgctggaggagcacagcaggatcaaagtgggcaaccctgcagaggactttgggaccttcttctctgcagtgattgatgccaaggccttcgcccgcataaagaagtggctggagcatgcgcgttcctcgcccagcctcagcatcctggcaggcggccagtgtaacgagtcggtgggttacttcgtggagccgtgtatcattgagagcaaggacccacaggagcccatcatgaaggaggagatcttcggccctgtgctgacagtgtatgtgtacccggatgagaaatacagagagacgctgcaactggtcgacagcaccaccagctatggcctcacgggggcagtgtttgcccaggataaaacaattgtccaagaagccacgaggatgctgaggaacgctgctggcaacttctacatcaacgacaagtctactggatctgtggtgggccagcagccctttgggggcgcccgggcctcaggaaccaatgacaaaccaggaggcccccactacatcttacgctggacctcaccccaggtcatcaaggagactcataagcccctgggggactggcgatactcctacatgcagtaa

SEQ ID NO: 158 - protein, 562 aa, Rattus norvegicus
MLPPALLRRSLLSYAWRGSGLRWKHASSLKVANEPILAFTQGSPERDALQKALNDLKDQTEAIPCVVGDEEVWTSDVRYQLSPFNHGHKVAKFCYADKALLNKAIEAAVLARKEWDLKPVADRAQIFLKAADMLSGPRRAEILAKTMVGQGKTVIQAEIDAAAELIDFFRFNAKFAVELEGEQPISVPPSTNHVVYRGLEGFVAAISPFNFTAIGGNLAGAPALMGNVVLWKPSDTAMLASYAVYRILREAGLPPNVIQFVPADGPTFGDTVTSSEHLCGINFTGSVPTFKHLWKQVAQNLDRFRTFPRLAGECGGKNFHFVHSSADVDSVVSGTLRSAFEYGGQKCSACSRLYVPQSLWPQIKGRLLEEHSRIKVGNPAEDFGTFFSAVIDAKAFARIKKWLEHARSSPSLSILAGGQCNESVGYFVEPCIIESKDPQEPIMKEEIFGPVLTVYVYPDEKYRETLQLVDSTTSYGLTGAVFAQDKTIVQEATRMLRNAAGNFYINDKSTGSVVGQQPFGGARASGTNDKPGGPHYILRWTSPQVIKETHKPLGDWRYSYMQ

SEQ ID NO: 159 - DNA, 1506 bp, Homo sapiens
  CDS (1)..(1506)
atgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataa

SEQ ID NO: 160 - protein, 501 aa, Homo sapiens
MSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGPTAGAAISSHMDIDKVAFTGSTEVGKLIKEAAGKSNLKRVTLELGGKSPCIVLADADLDNAVEFAHHGVFYHQGQCCIAASRIFVEESIYDEFVRRSVERAKKYILGNPLTPGVTQGPQIDKEQYDKILDLIESGKKEGAKLECGGGPWGNKGYFVQPTVFSNVTDEMRIAKEEIFGPVQQIMKFKSLDDVIKRANNTFYGLSAGVFTKDIDKAITISSALQAGTVWVNCYGVVSAQCPFGGFKMSGNGRELGEYGFHEYTEVKTVTVKISQKNS

SEQ ID NO: 161 - DNA, 1554 bp, Homo sapiens
  CDS (1)..(1554)
atgctgcgcttcctggcaccccggctgcttagcctccagggcaggaccgcccgctactcctcggcagcagccctcccaagccccattctgaacccagacatcccctacaaccagctgttcatcaacaatgaatggcaagatgcagtcagcaagaagaccttcccgacggtcaaccctaccaccggggaggtcattgggcacgtggctgaaggtgaccgggctgatgtggatcgggccgtgaaagcagcccgggaagccttccgcctggggtccccatggcgccggatggatgcctctgagcggggccggctgctgaaccgcctggcagacctagtggagcgggatcgagtctacttggcctcactcgagaccttggacaatgggaagcctttccaagagtcttacgccttggacttggatgaggtcatcaaggtgtatcggtactttgctggctgggctgacaagtggcatggcaagaccatccccatggatggccagcatttctgcttcacccggcatgagcccgttggtgtctgtggccagatcatcccgtggaacttccccttggtcatgcagggttggaaacttgccccggcactcgccacaggcaacactgtggttatgaaggtggcagagcagacccccctctctgccctgtatttggcctccctcatcaaggaggcaggctttccccctggggtggtgaacatcatcacggggtatggcccaacagcaggtgcggccatcgcccagcacgtggatgttgacaaagttgccttcaccggttccaccgaggtgggccacctgatccagaaagcagctggcgattccaacctcaagagagtcaccctggagctgggtggtaagagccccagcatcgtgctggccgatgctgacatggagcatgccgtggagcagtgccacgaagccctgttcttcaacatgggccagtgctgctgtgctggctcccggaccttcgtggaagaatccatctacaatgagtttctcgagagaaccgtggagaaagcaaagcagaggaaagtggggaacccctttgagctggacacccagcaggggcctcaggtggacaaggagcagtttgaacgagtcctaggctacatccagcttggccagaaggagggcgcaaaactcctctgtggcggagagcgtttcggggagcgtggtttcttcatcaagcctactgtctttggtggcgtgcaggatgacatgagaattgccaaagaggagatctttgggcctgtgcagcccctgttcaagttcaagaagattgaggaggtggttgagagggccaacaacaccaggtatggcctggctgcggctgtgttcacccgggatctggacaaggccatgtacttcacccaggcactccaggccgggaccgtgtgggtaaacacctacaacatcgtcacctgccacacgccatttggagggtttaaggaatctggaaacgggagggagctgggtgaggatgggcttaaggcctacacagaggtaaagacggtcaccatcaaggttcctcagaagaactcgtaa

SEQ ID NO: 162 - protein, 517 aa, Homo sapiens [sequence omitted]

SEQ ID NO: 163 - DNA, 1557 bp, Homo sapiens
  CDS (1)..(1557)
atgtttctccgagcaggcctggccgcgctctccccgcttcttcgcagtcttcggccctctcctgtcgccgccatgagcactggcaccttcgtcgtgtcgcagccgctcaattaccgcggcggggcccgcgtggagccggcggacgcctccggtaccgagaaagctttcgagccagcaaccggccgagtgatagctactttcacatgttcaggagaaaaggaagtaaatttggctgttcaaaatgcaaaggctgcttttaaaatatggagtcaaaaatctggcatggagcgttgccgaatccttttggaggctgccaggataataagggaacgggaggatgaaattgctactatggagtgcatcaacaatggcaagtccatctttgaggcccgcttggacattgacatttcctggcagtgcctggagtattatgcgggcttggctgcatccatggctggtgaacacatccagctcccaggtggatcgtttggttataccagaagagaaccacttggggtatgtgtgggaataggagcatggaactacccctttcagattgcctcttggaagtcggctccagcattagcctgtggtaatgccatggtctttaaaccttctccctttacacctgtttctgcattgctactggctgaaatctacagtgaggctggtgtacctcctgggctcttcaatgtggtgcagggaggggctgccacaggccagtttctgtgtcagcatcccgatgtggccaaagtctccttcactggaagtgtgcccactggcatgaagatcatggagatgtcagctaaaggaatcaaacctgttaccttggaacttggaggcaaatctccactcatcatcttctcagactgtgatatgaacaatgctgtaaagggggcgctgatggccaacttcctcacacaaggccaggtttgctgtaatggcacaagagtatttgtgcagaaagaaattcttgataaatttacagaggaagtggtgaaacagacccaaaggattaaaattggagatccccttctggaagatacaaggatgggtccactcatcaaccgaccacacctggagcgagtccttgggtttgtcaaagtggcaaaggagcagggtgctaaagtgttatgtggtggagatatatatgtacctgaagatcccaaattaaaggatggatattacatgagaccttgtgtattaactaattgcagagacgacatgacctgtgtgaaggaagagatctttgggcctgttatgtccattttatcatttgacactgaagctgaggttctagaaagagccaatgataccacttttggactagcagctggcgtctttaccagggacatccaacgggctcatagagtggtagctgagcttcaggctgggacgtgcttcattaacaactataacgtcagcccagtggagttgccctttggtggatataagaagtcaggatttggcagagagaacggccgtgtgacaatcgaatattattcacagctgaagactgtgtgtgtggagatgggtgatgtggaatctgctttttga

SEQ ID NO: 164 - protein, 518 aa, Homo sapiens
MFLRAGLAALSPLLRSLRPSPVAAMSTGTFVVSQPLNYRGGARVEPADASGTEKAFEPATGRVIATFTCSGEKEVNLAVQNAKAAFKIWSQKSGMERCRILLEAARIIREREDEIATMECINNGKSIFEARLDIDISWQCLEYYAGLAASMAGEHIQLPGGSFGYTRREPLGVCVGIGAWNYPFQIASWKSAPALACGNAMVFKPSPFTPVSALLLAEIYSEAGVPPGLFNVVQGGAATGQFLCQHPDVAKVSFTGSVPTGMKIMEMSAKGIKPVTLELGGKSPLIIFSDCDMNNAVKGALMANFLTQGQVCCNGTRVFVQKEILDKFTEEVVKQTQRIKIGDPLLEDTRMGPLINRPHLERVLGFVKVAKEQGAKVLCGGDIYVPEDPKLKDGYYMRPCVLTNCRDDMTCVKEEIFGPVMSILSFDTEAEVLERANDTTFGLAAGVFTRDIQRAHRVVAELQAGTCFINNYNVSPVELPFGGYKKSGFGRENGRVTIEYYSQLKTVCVEMGDVESAF

SEQ ID NO: 165 - DNA, 1458 bp, Homo sapiens
  CDS (1)..(1458)
atggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaaggcagaatattactga

SEQ ID NO: 166 - protein, 485 aa, Homo sapiens
MELEVRRVRQAFLSGRSRPLRFRLQQLEALRRMVQEREKDILTAIAADLCKSEFNVYSQEVITVLGEIDFMLENLPEWVTAKPVKKNVLTMLDEAYIQPQPLGVVLIIGAWNYPFVLTIQPLIGAIAAGNAVIIKPSELSENTAKILAKLLPQYLDQDLYIVINGGVEETTELLKQRFDHIFYTGNTAVGKIVMEAAAKHLTPVTLELGGKSPCYIDKDCDLDIVCRRITWGKYMNCGQTCIAPDYILCEASLQNQIVWKIKETVKEFYGENIKESPDYERIINLRHFKRILSLLEGQKIAFGGETDEATRYIAPTVLTDVDPKTKVMQEEIFGPILPIVPVKNVDEAINFINEREKPLALYVFSHNHKLIKRMIDETSSGGVTGNDVIMHFTLNSFPFGGVGSSGMGAYHGKHSFDTFSHQRPCLLKSLKREGANKLRYPPNSQSKVDWGKFFLLKRFNKEKLGLLLLTFLGIVAAVLVKAEYY

SEQ ID NO: 167 - DNA, 1620 bp, Homo sapiens
  CDS (1)..(1620)
atgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaa

SEQ ID NO: 168 - protein, 539 aa, Homo sapiens
MWRLPRALCVHAAKTSKLSGPWSRPAAFMSTLLINQPQYAWLKELGLREENEGVYNGSWGGRGEVITTYCPANNEPIARVRQASVADYEETVKKAREAWKIWADIPAPKRGEIVRQIGDALREKIQVLGSLVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFGRSLLELGGNNAIIAFEDADLSLVVPSALFAAVGTAGQRCTTARRLFIHESIHDEVVNRLKKAYAQIRVGNPWDPNVLYGPLHTKQAVSMFLGAVEEAKKEGGTVVYGGKVMDRPGNYVEPTIVTGLGHDASIAHTETFAPILYVFKFKNEEEVFAWNNEVKQGLSSSIFTKDLGRIFRWLGPKGSDCGIVNVNIPTSGAEIGGAFGGEKHTGGGRESGSDAWKQYMRRSTCTINYSKDLPLAQGIKFQ

SEQ ID NO: 169 - DNA, 1314 bp, Homo sapiens
  CDS (1)..(1314)
atggctggaacaaacgcacttttgatgctggaaaacttcatagatggaaaatttttaccttgtagctcatatatagattcttacgacccatcaacaggggaagtgtattgcagagtgccaaatagtggaaaagacgagatcgaagccgcggtcaaggccgccagagaagcctttcccagctggtcatcccgcagcccccaggagcgctcacgggtcctgaaccaggtggcggatttgctggagcagtccctggaggagtttgcccaggccgagtctaaagaccaagggaaaaccttagcactggcaagaaccatggacattccccggtctgtgcagaacttcaggttcttcgcttcctccagcctgcaccacacgtcagagtgcacgcagatggaccacctgggctgcatgcactacacggtgcgggccccggtgggagtcggtgttccaccaggtgtggtcaatattgtgtttggaaccgggcccagggtgggtgaggccctggtgtcccacccagaggtgcccctgatctccttcaccgggagccagcccaccgctgagcggatcacccagctgagcgctccccactgcaaaaagctctccctggagctggggggcaagaatcctgccatcatctttgaggacgccaacctggatgagtgcattccggcaaccgtcaggtccagctttgccaaccagggtgaaatctgtctctgtaccagcaggatctttgtccagaagagcatctatagtgaatttttaaagagatttgtagaagctaccagaaagtggaaagtcggcattccctctgatccactggtgagcataggtgctctgataagtaaagcacatttggagaaagtcagaagttacgtcaagagagctcttgctgaaggtgcccaaatttggtgcggtgagggagtggataagttgagcctccctgccaggaaccaggcaggctactttatgcttcccacggtgataacagacattaaggatgaatcctgctgcatgacggaagagatatttggtccagtgacgtgtgtcgtcccctttgatagtgaagaggaggtgattgaaagagccaacaacgttaagtatgggctggcggctaccgtgtggtccagcaatgtggggcgcgtccaccgggtggctaagaagctgcagtctggcttggtctggaccaactgctggctcatcagggagctgaaccttcctttcggggggatgaagagttctggaataggtagagagggagccaaggactcttacgacttcttcactgagatcaaaaccatcaccgttaaacactga

SEQ ID NO: 170 - protein, 437 aa, Homo sapiens
MAGTNALLMLENFIDGKFLPCSSYIDSYDPSTGEVYCRVPNSGKDEIEAAVKAAREAFPSWSSRSPQERSRVLNQVADLLEQSLEEFAQAESKDQGKTLALARTMDIPRSVQNFRFFASSSLHHTSECTQMDHLGCMHYTVRAPVGVGVPPGVVNIVFGTGPRVGEALVSHPEVPLISFTGSQPTAERITQLSAPHCKKLSLELGGKNPAIIFEDANLDECIPATVRSSFANQGEICLCTSRIFVQKSIYSEFLKRFVEATRKWKVGIPSDPLVSIGALISKAHLEKVRSYVKRALAEGAQIWCGEGVDKLSLPARNQAGYFMLPTVITDIKDESCCMTEEIFGPVTCVVPFDSEEEVIERANNVKYGLAATVWSSNVGRVHRVAKKLQSGLVWTNCWLIRELNLPFGGMKSSGIGREGAKDSYDFFTEIKTITVKH

SEQ ID NO: 171 - DNA, 47 bp, Artificial Sequence
  Synthetic DNA
aacaaacaaaggatccaaaaaaatgcgttatgcacaccctggccagc

SEQ ID NO: 172 - DNA, 44 bp, Artificial Sequence
  Synthetic DNA
gtcgtattacggatccttatcagaacaggcccagcggcgcggtg

SEQ ID NO: 173 - DNA, 54 bp, Artificial Sequence
  Synthetic DNA
cggtacccggggatccaaggagatataccatgacgtcgatgaatctgcctattg

SEQ ID NO: 174 - DNA, 41 bp, Artificial Sequence
  Synthetic DNA
cgactctagaggatcctcaacgtttaagttcctccgccaac

SEQ ID NO: 175 - DNA, 54 bp, Artificial Sequence
  Synthetic DNA
cggtacccggggatccaaggagatataccatgtctttgaccttcccagtaatca

SEQ ID NO: 176 - DNA, 41 bp, Artificial Sequence
  Synthetic DNA
cgactctagaggatcctcacggcaaagcgaggtaacgcacg

SEQ ID NO: 177 - DNA, 54 bp, Artificial Sequence
  Synthetic DNA
cggtacccggggatccaaggagatataccatgactgtctacgcaaatccaggaa

SEQ ID NO: 178 - DNA, 41 bp, Artificial Sequence
  Synthetic DNA
cgactctagaggatcctcagaacagtccggttgggtttgga

SEQ ID NO: 179 - DNA, 54 bp, Artificial Sequence
  Synthetic DNA
cggtacccggggatccaaggagatataccatgactattaatgtctccgaactac

SEQ ID NO: 180 - DNA, 41 bp, Artificial Sequence
  Synthetic DNA
cgactctagaggatccctagccggcgtaaggatcccggata

SEQ ID NO: 181 - DNA, 54 bp, Artificial Sequence
  Synthetic DNA
cggtacccggggatccaaggagatataccatgactgcaacatttgctggaatcg

SEQ ID NO: 182 - DNA, 41 bp, Artificial Sequence
  Synthetic DNA
cgactctagaggatccttagctgcgcttgatgccgatccat

SEQ ID NO: 183 - DNA, 54 bp, Artificial Sequence
  Synthetic DNA
cggtacccggggatccaaggagatataccatgatcaaacgtcttcctttaggtc

SEQ ID NO: 184 - DNA, 41 bp, Artificial Sequence
  Synthetic DNA
cgactctagaggatccctacggcaaaactttaaagattttg

SEQ ID NO: 185 - DNA, 54 bp, Artificial Sequence
  Synthetic DNA
cggtacccggggatccaaggagatataccatggcatatcaaagtatcaatccat

SEQ ID NO: 186 - DNA, 41 bp, Artificial Sequence
  Synthetic DNA
cgactctagaggatccttattgtcgtgcttcgtaaattaga

SEQ ID NO: 187 - DNA, 39 bp, Artificial Sequence
  Synthetic DNA
cggtacccggggatccgctttctcgcacaagagctgcag

SEQ ID NO: 188 - DNA, 44 bp, Artificial Sequence
  Synthetic DNA
cgactctagaggatccttatcaacgaattggcttgtcaatggca

SEQ ID NO: 189 - DNA, 39 bp, Artificial Sequence
  Synthetic DNA
cggtacccggggatccgctatcagcaaggtgcctcaaat

SEQ ID NO: 190 - DNA, 44 bp, Artificial Sequence
  Synthetic DNA
cgactctagaggatccttattattcataattcgatggatatttg

SEQ ID NO: 191 - DNA, 39 bp, Artificial Sequence
  Synthetic DNA
cggtacccggggatccgtccaaggtctatctgaattcag

SEQ ID NO: 192 - DNA, 44 bp, Artificial Sequence
  Synthetic DNA
cgactctagaggatccttactagctggcttctttagctaaagag

SEQ ID NO: 193 - DNA, 39 bp, Artificial Sequence
  Synthetic DNA
cggtacccggggatccgcctaccttgtatactgatatcg

SEQ ID NO: 194 - DNA, 44 bp, Artificial Sequence
  Synthetic DNA
cgactctagaggatccttattatttatccaatgaaagatccaca

SEQ ID NO: 195 - DNA, 39 bp, Artificial Sequence; identical to SEQ ID NO: 193
  Synthetic DNA

SEQ ID NO: 196 - DNA, 44 bp, Artificial Sequence
  Synthetic DNA
cgactctagaggatccttattagttgtccaaagagagatttatg

SEQ ID NO: 197 - DNA, 39 bp, Artificial Sequence
  Synthetic DNA
cggtacccggggatccgttcagtagatctacgctctgct

SEQ ID NO: 198 - DNA, 41 bp, Artificial Sequence
  Synthetic DNA
cgactctagaggatccttactcgtccaatttggcacggacc

SEQ ID NO: 199 - DNA, 39 bp, Artificial Sequence
  Synthetic DNA
cggtacccggggatccgactttgagtaagtattctaaac

SEQ ID NO: 200 - DNA, 44 bp, Artificial Sequence
  Synthetic DNA
cgactctagaggatccttattaaatgctgtttggcaaattccca

SEQ ID NO: 201 - DNA, 39 bp, Artificial Sequence
  Synthetic DNA
cggtacccggggatccgtcaaacgacggctcaaaaatat

SEQ ID NO: 202 - DNA, 44 bp, Artificial Sequence
  Synthetic DNA
cgactctagaggatccttatcaggaagaacaatgagcgtaaatg

SEQ ID NO: 203 - DNA, 39 bp, Artificial Sequence
  Synthetic DNA
cggtacccggggatccgactaagctacactttgacactg

SEQ ID NO: 204 - DNA, 44 bp, Artificial Sequence
  Synthetic DNA
cgactctagaggatccttattacaacttaattctgacagctttt

SEQ ID NO: 205 - DNA, 41 bp, Artificial Sequence
  Synthetic DNA
cggtacccggggatccaacaaacaaaggatccaaaaaaatg

SEQ ID NO: 206 - DNA, 41 bp, Artificial Sequence
  Synthetic DNA
cgactctagaggatcctagtgagtcgtattacggatcctta

SEQ ID NO: 207 - DNA, 39 bp, Artificial Sequence
  Synthetic DNA
cggtacccggggatccggcatcaagaagagtttcttcgc

SEQ ID NO: 208 - DNA, 44 bp, Artificial Sequence
  Synthetic DNA
cgactctagaggatccttattagagccaggcagggttcttgagg

SEQ ID NO: 209 - DNA, 39 bp, Artificial Sequence
  Synthetic DNA
cggtacccggggatccggcgattccgatgcctactcgcc

SEQ ID NO: 210 - DNA, 44 bp, Artificial Sequence
  Synthetic DNA
cgactctagaggatccttattagttgggagatttgtaccatccc

SEQ ID NO: 211 - DNA, 39 bp, Artificial Sequence
  Synthetic DNA
cggtacccggggatccggtaataggagcagcagcgcgtg

SEQ ID NO: 212 - DNA, 44 bp, Artificial Sequence
  Synthetic DNA
cgactctagaggatccttatcagtgtctattcatatctcccaag

SEQ ID NO: 213 - DNA, 39 bp, Artificial Sequence
  Synthetic DNA
cggtacccggggatccggccgggactggattgtttgctg

SEQ ID NO: 214 - DNA, 44 bp, Artificial Sequence
  Synthetic DNA
cgactctagaggatccttactaacccatagagtaagaaggtgta

SEQ ID NO: 215 - DNA, 39 bp, Artificial Sequence
  Synthetic DNA
cggtacccggggatccggagaacggcaaatgcaacggag

SEQ ID NO: 216 - DNA, 44 bp, Artificial Sequence
  Synthetic DNA
cgactctagaggatccttattacatccaaggggaattgtgaaga

SEQ ID NO: 217 - DNA, 39 bp, Artificial Sequence
  Synthetic DNA
cggtacccggggatccggcggctcgtagagtgtcttctc

SEQ ID NO: 218 - DNA, 44 bp, Artificial Sequence
  Synthetic DNA
cgactctagaggatccttatcagatccaggcaggcttatttaga

SEQ ID NO: 219 - DNA, 39 bp, Artificial Sequence
  Synthetic DNA
cggtacccggggatccgggttcggcgaacaacgagtacg

SEQ ID NO: 220 - DNA, 44 bp, Artificial Sequence
  Synthetic DNA
cgactctagaggatccttactaaccgaagttaattccttgcgct

SEQ ID NO: 221 - DNA, 39 bp, Artificial Sequence
  Synthetic DNA
cggtacccggggatccgctgcgcgttttgaagaccggtg

SEQ ID NO: 222 - DNA, 44 bp, Artificial Sequence
  Synthetic DNA
cgactctagaggatccttattaggagttcttctgggcaaccttg

SEQ ID NO: 223 - DNA, 39 bp, Artificial Sequence
  Synthetic DNA
cggtacccggggatccgttgcgaatgatgcgaagttcct

SEQ ID NO: 224 - DNA, 44 bp, Artificial Sequence
  Synthetic DNA
cgactctagaggatccttattactcgcacatgtatggatagttg

SEQ ID NO: 225 - DNA, 39 bp, Artificial Sequence
  Synthetic DNA
cggtacccggggatccggctctaaaaatgagaatcgcaa

SEQ ID NO: 226 - DNA, 44 bp, Artificial
  Synthetic DNA
cgactctagaggatccttactaatattcaactgtgacacacttg

SEQ ID NO: 227 - DNA, 39 bp, Artificial Sequence
  Synthetic DNA
cggtacccggggatccgtttgacaacgcgattaaacctc

SEQ ID NO: 228 - DNA, 44 bp, Artificial Sequence
  Synthetic DNA
cgactctagaggatccttatcacgtccaccaagatggtgggttc

SEQ ID NO: 229 - DNA, 39 bp, Artificial Sequence
  Synthetic DNA
cggtacccggggatccggccgatcccaacgccaagccca

SEQ ID NO: 230 - DNA, 44 bp, Artificial Sequence
  Synthetic DNA
cgactctagaggatccttattaaagaagtttcatggtgatggtc

SEQ ID NO: 231 - DNA, 39 bp, Artificial Sequence
  Synthetic DNA
cggtacccggggatccgtggcgacagctcagcggagtcg

SEQ ID NO: 232 - DNA, 44 bp, Artificial Sequence
  Synthetic DNA
cgactctagaggatccttatcagtcgtacttgaggttgcccatg

SEQ ID NO: 233 - DNA, 39 bp, Artificial Sequence
  Synthetic DNA
cggtacccggggatccgttggcacaattgagaaatattt

SEQ ID NO: 234 - DNA, 44 bp, Artificial Sequence
  Synthetic DNA
cgactctagaggatccttactactccacattgaagacaacaccc

SEQ ID NO: 235 - DNA, 39 bp, Artificial Sequence
  Synthetic DNA
cggtacccggggatccgtcttcccctgcacagcctgcag

SEQ ID NO: 236 - DNA, 44 bp, Artificial Sequence
  Synthetic DNA
cgactctagaggatccttattaggagttcttctgagatattttc

SEQ ID NO: 237 - DNA, 39 bp, Artificial Sequence
  Synthetic DNA
cggtacccggggatccgctgccgccggctttgcttcgcc

SEQ ID NO: 238 - DNA, 44 bp, Artificial Sequence
  Synthetic DNA
cgactctagaggatccttattactgcatgtaggagtatcgccag

SEQ ID NO: 239 - DNA, 39 bp, Artificial Sequence
  Synthetic DNA
cggtacccggggatccgtcatcctcaggcacgccagact

SEQ ID NO: 240 - DNA, 44 bp, Artificial Sequence
  Synthetic DNA
cgactctagaggatccttattatgagttcttctgagagattttc

SEQ ID NO: 241 - DNA, 39 bp, Artificial Sequence
  Synthetic DNA
cggtacccggggatccgctgcgcttcctggcaccccggc

SEQ ID NO: 242 - DNA, 44 bp, Artificial Sequence
  Synthetic DNA
cgactctagaggatccttattacgagttcttctgaggaaccttg

SEQ ID NO: 243 - DNA, 39 bp, Artificial Sequence
  Synthetic DNA
cggtacccggggatccgtttctccgagcaggcctggccg

SEQ ID NO: 244 - DNA, 44 bp, Artificial Sequence
  Synthetic DNA
cgactctagaggatccttatcaaaaagcagattccacatcaccc

SEQ ID NO: 245 - DNA, 39 bp, Artificial Sequence
  Synthetic DNA
cggtacccggggatccggagctcgaagtccggcgggtcc

SEQ ID NO: 246 - DNA, 44 bp, Artificial Sequence
  Synthetic DNA
cgactctagaggatccttatcagtaatattctgccttgacaagc

SEQ ID NO: 247 - DNA, 39 bp, Artificial Sequence
  Synthetic DNA
cggtacccggggatccgtggcgccttcctcgcgcgctgt

SEQ ID NO: 248 - DNA, 44 bp, Artificial Sequence
  Synthetic DNA
cgactctagaggatccttattactgaaacttgattccttgggcc

SEQ ID NO: 249 - DNA, 39 bp, Artificial Sequence
  Synthetic DNA
cggtacccggggatccggctggaacaaacgcacttttga

SEQ ID NO: 250 - DNA, 44 bp, Artificial Sequence
  Synthetic DNA
cgactctagaggatccttatcagtgtttaacggtgatggttttg

The invention claimed is:

1. A method for producing a hydrocarbon, said method comprising incubating together:
    a protein having an activity of synthesizing, from an aldehyde compound, a hydrocarbon with a carbon number one less than that of the aldehyde compound, wherein said protein is selected from the group consisting of (a) and (b):
        (a) a protein comprising an amino acid sequence selected from the group consisting of SEQ ID NOs: 12, 26, 66, 72, 76, 80, 90, 92, 94, 98, 112, 116, 122 and 144; and
        (b) a protein comprising an amino acid sequence having 90% or more identity to an amino acid sequence selected from the group consisting of SEQ ID NOs: 12, 26, 66, 72, 76, 80, 90, 92, 94, 98, 112, 116, 122 and 144, and having an activity of synthesizing, from an aldehyde compound, a hydrocarbon with a carbon number one less than that of the aldehyde compound;
    a coenzyme involved in said activity of said protein, wherein the coenzyme is reduced nicotinamide adenine dinucleotide (NADH) or nicotinamide adenine dinucleotide phosphate, and
    an aldehyde compound that serves as a substrate for said activity of said protein,
    to thereby synthesize a hydrocarbon with a carbon number one less than that of the aldehyde compound.

2. The method for producing a hydrocarbon according to claim 1, wherein the protein, the coenzyme, and the aldehyde compound are incubated together by culturing a transformant, into which a gene encoding said protein has been introduced, in a solution containing the aldehyde compound.

3. The method for producing a hydrocarbon according to claim 1, wherein the protein, the coenzyme, and the aldehyde compound are incubated together by mixing an enzyme liquid, extracted from a transformant into which a gene encoding said protein has been introduced, with a solution containing the aldehyde compound.

4. The method for producing a hydrocarbon according to claim 1, wherein the protein, the coenzyme, and the aldehyde compound are incubated together by mixing the protein, isolated from a transformant into which a gene encoding said protein has been introduced, with a solution containing the aldehyde compound and the coenzyme.

5. The method for producing a hydrocarbon according to claim 1, wherein the aldehyde compound is a $C_{11}$-$C_{21}$ aldehyde compound.

6. The method for producing a hydrocarbon according to claim 1, wherein the coenzyme is reduced nicotinamide adenine dinucleotide (NADH).

* * * * *